US008258288B2

(12) United States Patent
McSwiggen et al.

(10) Patent No.: US 8,258,288 B2
(45) Date of Patent: *Sep. 4, 2012

(54) RNA INTERFERENCE MEDIATED INHIBITION OF RESPIRATORY SYNCYTIAL VIRUS (RSV) EXPRESSION USING SHORT INTERFERING NUCLEIC ACID (SINA)

(75) Inventors: James McSwiggen, Boulder, CO (US); Leonid Beigelman, San Mateo, CA (US)

(73) Assignee: Sirna Therapeutics, Inc., Boulder, CO (US)

(*) Notice: Subject to any disclaimer, the term of this patent is extended or adjusted under 35 U.S.C. 154(b) by 190 days.

This patent is subject to a terminal disclaimer.

(21) Appl. No.: 12/247,971

(22) Filed: Oct. 8, 2008

(65) Prior Publication Data

US 2009/0281164 A1  Nov. 12, 2009

Related U.S. Application Data

(63) Continuation of application No. 11/395,833, filed on Mar. 31, 2006, now abandoned, which is a continuation-in-part of application No. 11/369,108, filed on Mar. 6, 2006, now abandoned, which is a continuation-in-part of application No. 10/923,536, filed on Aug. 20, 2004, now abandoned, which is a continuation-in-part of application No. PCT/US2004/016390, filed on May 24, 2004, which is a continuation-in-part of application No. 10/826,966, filed on Apr. 16, 2004, now abandoned, which is a continuation-in-part of application No. 10/757,803, filed on Jan. 14, 2004, which is a continuation-in-part of application No. 10/720,448, filed on Nov. 24, 2004, which is a continuation-in-part of application No. 10/693,059, filed on Oct. 23, 2003, now abandoned, which is a continuation-in-part of application No. 10/444,853, filed on May 23, 2003, which is a continuation-in-part of application No. PCT/US03/05346, filed on Feb. 20, 2003, and a continuation-in-part of application No. PCT/US03/05028, filed on Feb. 20, 2003, said application No. 11/395,833 is a continuation-in-part of application No. PCT/US2005/004270, filed on Feb. 9, 2005.

(60) Provisional application No. 60/358,580, filed on Feb. 20, 2002, provisional application No. 60/363,124, filed on Mar. 11, 2002, provisional application No. 60/386,782, filed on Jun. 6, 2002, provisional application No. 60/406,784, filed on Aug. 29, 2002, provisional application No. 60/408,378, filed on Sep. 5, 2002, provisional application No. 60/409,293, filed on Sep. 9, 2002, provisional application No. 60/440,129, filed on Jan. 15, 2003, provisional application No. 60/543,480, filed on Feb. 10, 2004.

(51) Int. Cl.
C07H 21/04 (2006.01)

(52) U.S. Cl. .................................................. 536/24.5
(58) Field of Classification Search .............. 435/6, 91.1, 435/91, 31, 455; 514/44; 536/23.1, 24.5
See application file for complete search history.

(56) References Cited

U.S. PATENT DOCUMENTS

| | | | |
|---|---|---|---|
| 5,814,620 A | 9/1998 | Robinson et al. | |
| 5,998,203 A | 12/1999 | Matulic-Adamic et al. | |
| 5,998,206 A | 12/1999 | Cowsert | |
| 6,133,246 A * | 10/2000 | McKay et al. | 514/44 A |
| 6,262,036 B1 * | 7/2001 | Arnold et al. | 514/44 A |
| 6,673,611 B2 * | 1/2004 | Thompson et al. | 435/455 |
| 6,689,367 B1 * | 2/2004 | Collins et al. | 424/211.1 |
| 6,821,955 B2 * | 11/2004 | Orson et al. | 514/44 R |
| 7,855,284 B2 * | 12/2010 | McSwiggen et al. | 536/24.5 |
| 7,893,248 B2 * | 2/2011 | McSwiggen et al. | 536/24.5 |
| 7,897,752 B2 * | 3/2011 | McSwiggen et al. | 536/24.5 |
| 7,897,753 B2 * | 3/2011 | McSwiggen et al. | 536/24.5 |
| 7,897,755 B2 * | 3/2011 | McSwiggen et al. | 536/24.5 |
| 7,897,756 B2 * | 3/2011 | McSwiggen et al. | 536/24.5 |
| 7,910,724 B2 * | 3/2011 | McSwiggen et al. | 536/24.5 |
| 7,910,725 B2 * | 3/2011 | McSwiggen et al. | 536/24.5 |
| 7,915,400 B2 * | 3/2011 | McSwiggen et al. | 536/24.5 |
| 7,923,549 B2 * | 4/2011 | McSwiggen et al. | 536/24.5 |

(Continued)

FOREIGN PATENT DOCUMENTS

CA 2359180 A1 3/2000

(Continued)

OTHER PUBLICATIONS

Elbashir et al., EMBO J., vol. 20, No. 23, pp. 6877-6888 (2001).*

(Continued)

*Primary Examiner* — Brian Whiteman
(74) *Attorney, Agent, or Firm* — Laura M. Ginkel; David A. Muthard

(57) ABSTRACT

This invention relates to compounds, compositions, and methods useful for modulating sespiratory syncytial virus (RSV) gene expression using short interfering nucleic acid (siNA) molecules. This invention also relates to compounds, compositions, and methods useful for modulating the expression and activity of other genes involved in pathways of RSV gene expression and/or activity by RNA interference (RNAi) using small nucleic acid molecules. In particular, the instant invention features small nucleic acid molecules, such as short interfering nucleic acid (siNA), short interfering RNA (siRNA), double-stranded RNA (dsRNA), micro-RNA (miRNA), and short hairpin RNA (shRNA) molecules and methods used to modulate the expression of RSV genes, including cocktails of such small nucleic acid molecules and lipid nanoparticle formulations of such small nucleic acid molecules cocktails thereof. The application also relates to methods of treating diseases and conditions associated with RSV gene expression, such as RSV infection, respiratory failure, bronchiolitis and pneumonia, as well as providing dosing regimens and treatment protocols.

5 Claims, 35 Drawing Sheets

U.S. PATENT DOCUMENTS

| | | | |
|---|---|---|---|
| 7,928,219 B2* | 4/2011 | McSwiggen et al. | 536/24.5 |
| 7,928,220 B2* | 4/2011 | McSwiggen et al. | 536/24.5 |
| 7,943,757 B2* | 5/2011 | McSwiggen et al. | 536/24.5 |
| 7,956,176 B2* | 6/2011 | McSwiggen et al. | 536/24.5 |
| 7,956,178 B2* | 6/2011 | McSwiggen et al. | 536/24.5 |
| 2004/0009541 A1* | 1/2004 | Singh et al. | 435/7.23 |
| 2004/0053875 A1 | 3/2004 | Kreutzer et al. | |
| 2004/0248299 A1* | 12/2004 | Jayasena et al. | 435/455 |
| 2005/0020521 A1 | 1/2005 | Rana | |
| 2005/0080246 A1 | 4/2005 | Allerson et al. | |
| 2005/0142535 A1* | 6/2005 | Damha et al. | 435/5 |
| 2006/0089324 A1* | 4/2006 | Barik | 514/44 |
| 2007/0042350 A1* | 2/2007 | Li et al. | 435/5 |
| 2008/0318210 A1* | 12/2008 | Bentwich | 435/6 |

FOREIGN PATENT DOCUMENTS

| | | |
|---|---|---|
| WO | 90/14090 A1 | 11/1990 |
| WO | 94/01550 A1 | 1/1994 |
| WO | 99/32619 A1 | 7/1999 |
| WO | 99/49029 A1 | 9/1999 |
| WO | 00/44895 A1 | 8/2000 |
| WO | 00/44914 A1 | 8/2000 |
| WO | 01/36646 A1 | 5/2001 |
| WO | 01/96584 A2 | 3/2002 |
| WO | 02/22636 A1 | 3/2002 |
| WO | 02/44321 A2 | 6/2002 |
| WO | 03/064626 A2 | 8/2003 |

OTHER PUBLICATIONS

Elbashir et al, EMBO J., vol. 20, No. 23, pp. 6877-6888 (2001).*
Parrish et al., Molecular Cell, vol. 6, pp. 1077-1087 (2000).*
Anderson et al. "Bispecific Short Hairpin siRNA Constructs Targeted to CD4, CXCR4, and CCR5 Confer HIV-1 Resistance," Oligonucleotides 13(5):303-312 (2003).
Elbashir et al. "Analysis of Gene Function in Somatic Mammalian Cells Using Small Interfering RNAs," Methods 26 (2):199-213 (2002).
Elbashir et al. "Duplexes of 21-Nucleotide RNAs Mediate RNA Interference in Cultured Mammalian Cells," Nature 411(6836):494-498 (2001).
Elbashir et al. "Functional Anatomy of siRNAs for Mediating Efficient RNAi in *Drosophila melanogaster* Embryo Lysate," EMBO J. 20(23):6877-6888 (2001).
Elbashir et al. "RNA Interference is Mediated by 21- and 22-Nucleotide RNAs," Genes Dev. 15(2):188-200 (2001).
Fire et al. "Potent and Specific Genetic Interference by Double-Stranded RNA in *Caenorhabditis elegans*," Nature 391:806-811 (1998).
Futami et al. "Induction of Apoptosis in HeLa Cells with siRNA Expression Vector Targeted Against Bcl-2," Nucleic Acids Research Supplement 2:251-252 (2002).
International Search Report mailed on Mar. 31, 2005 for PCT/US04/16390, 2 pages.
International Search Report mailed on Oct. 17, 2003 for PCT/US03/05028, 2 pages.
International Search Report mailed on Oct. 17, 2003 for PCT/US03/05346, 1 page.
Leirdal et al. "Gene Silencing in Mammalian Cells by Preformed Small RNA Duplexes," Biochemical and Biophysical Research Communications 295:744-748 (2002).
Lin et al. "A Novel mRNA-cDNA Interference Phenomenon for Silencing Bcl-2 Expression in Human LNCaP Cells," Biochemical and Biophysical Research Communications 281:639-644 (2001).
Tuschl et al. "Small Interfering RNAs: A Revolutionary Tool for the Analysis of Gene Function and Gene Therapy," Molecular Interventions 295(3):158-167 (2002).
Tuschl et al. "Targeted mRNA Degradation by Double-Stranded RNA In Vitro," Genes and Development 13 (24):3191-3197 (1999).
Office Action mailed on Feb. 4, 2008 for U.S. Appl. No. 10/444,853, 37 pages.
Office Action mailed on Jul. 1, 2008 for U.S. Appl. No. 11/499,520, 13 pages.
Office Action mailed on Oct. 8, 2008 for U.S. Appl. No. 11/499,529, 34 pages.
Office Action mailed on Nov. 14, 2008 for U.S. Appl. No. 11/502,875, 14 pages.
Office Action mailed on Apr. 8, 2009 for U.S. Appl. No. 11/502,876, 31 pages.
Office Action mailed on Jan. 26, 2009 for U.S. Appl. No. 11/676,124, 15 pages.
Office Action mailed on Feb. 3, 2009 for U.S. Appl. No. 10/693,059, 7 pages.
Office Action mailed on Jul. 2, 2008 for U.S. Appl. No. 10/757,803, 26 pages.
Office Action mailed on Apr. 16, 2009 for U.S. Appl. No. 12/105,010, 24 pages.
Office Action mailed on Oct. 10, 2008 for U.S. Appl. No. 11/499,521, 37 pages.

* cited by examiner

Figure 1
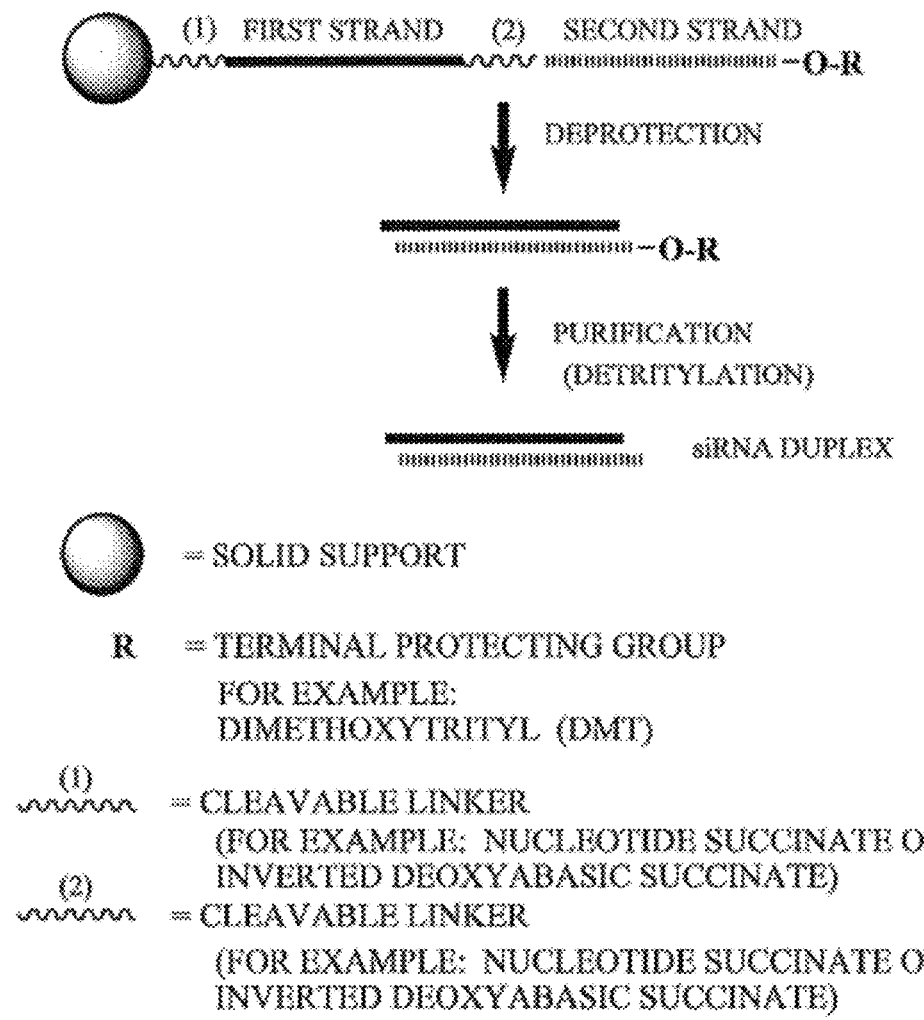
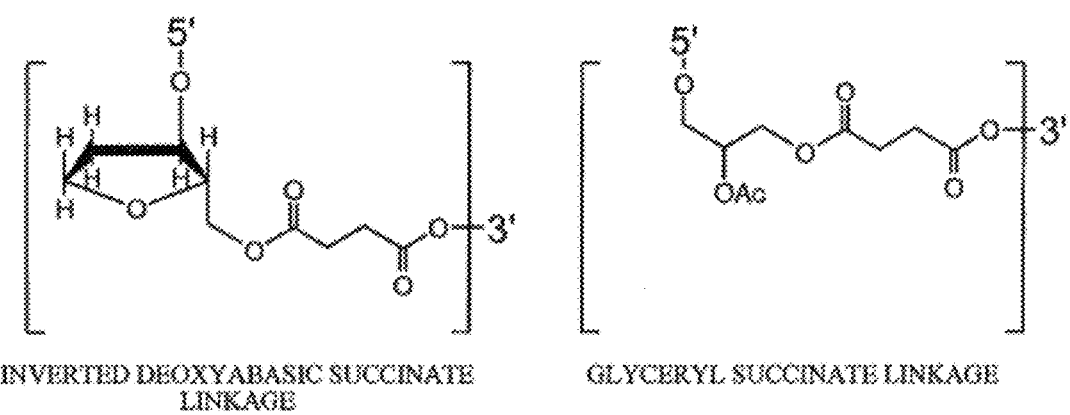
INVERTED DEOXYABASIC SUCCINATE LINKAGE
GLYCERYL SUCCINATE LINKAGE

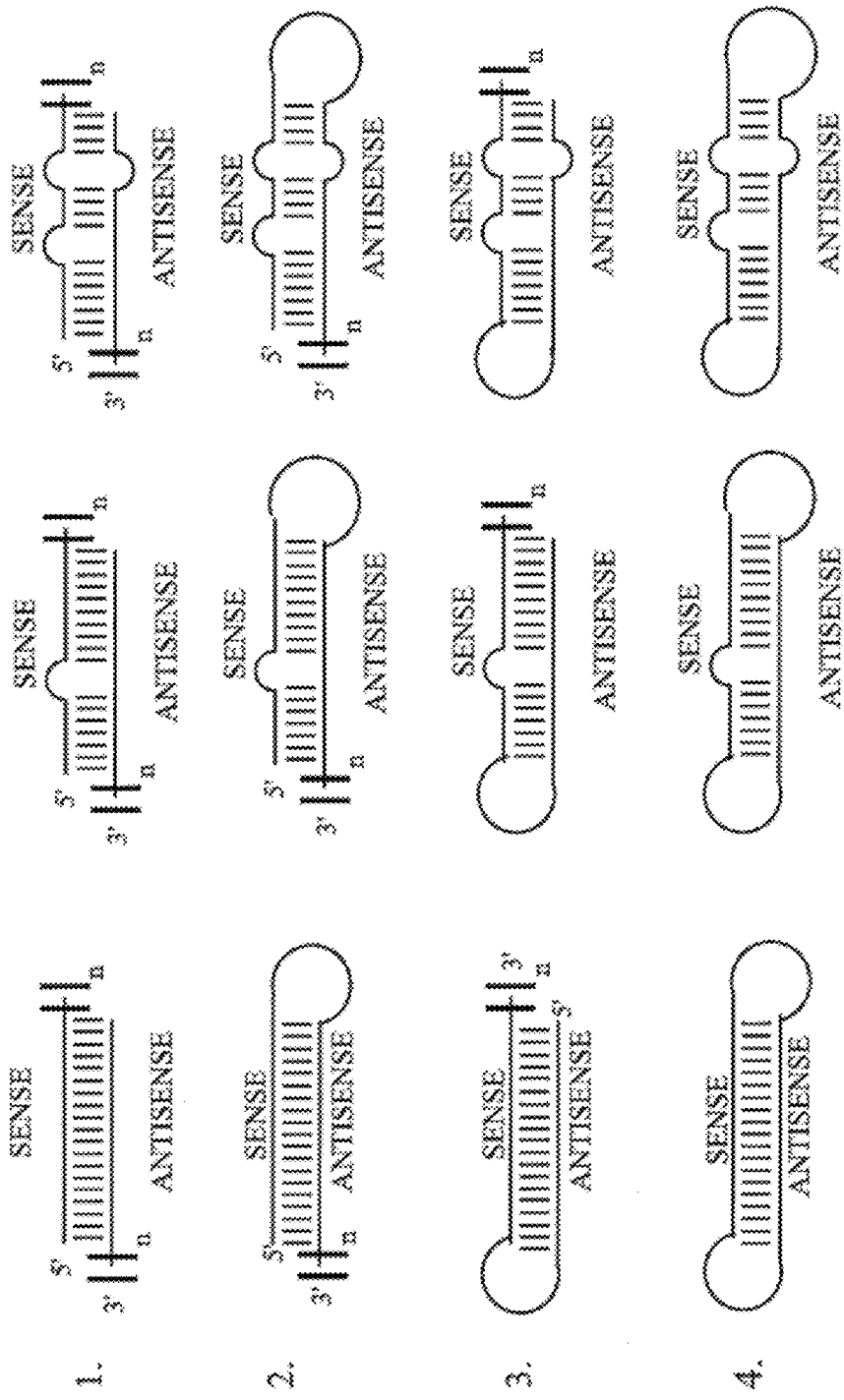

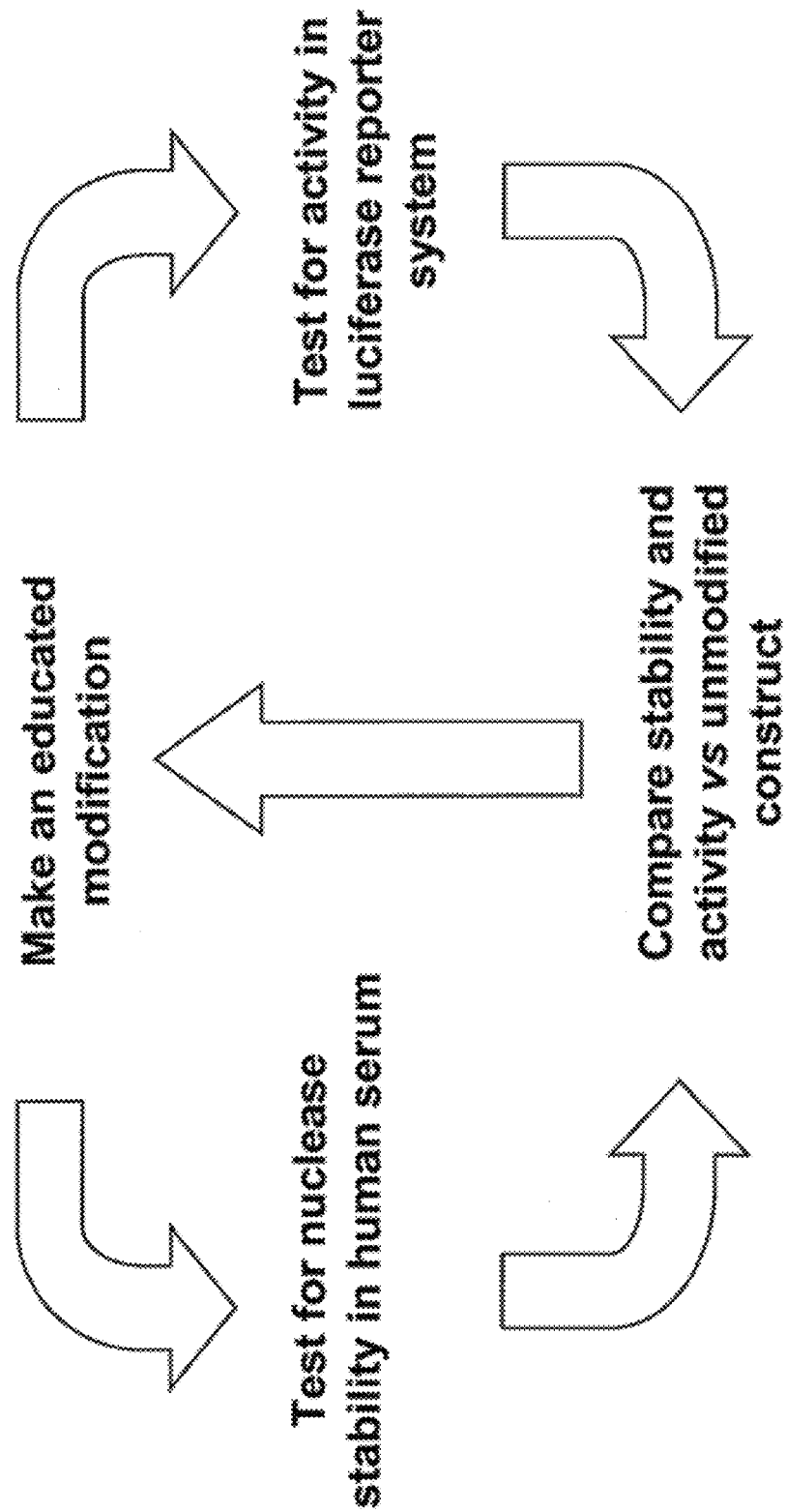
Figure 11: Modification Strategy

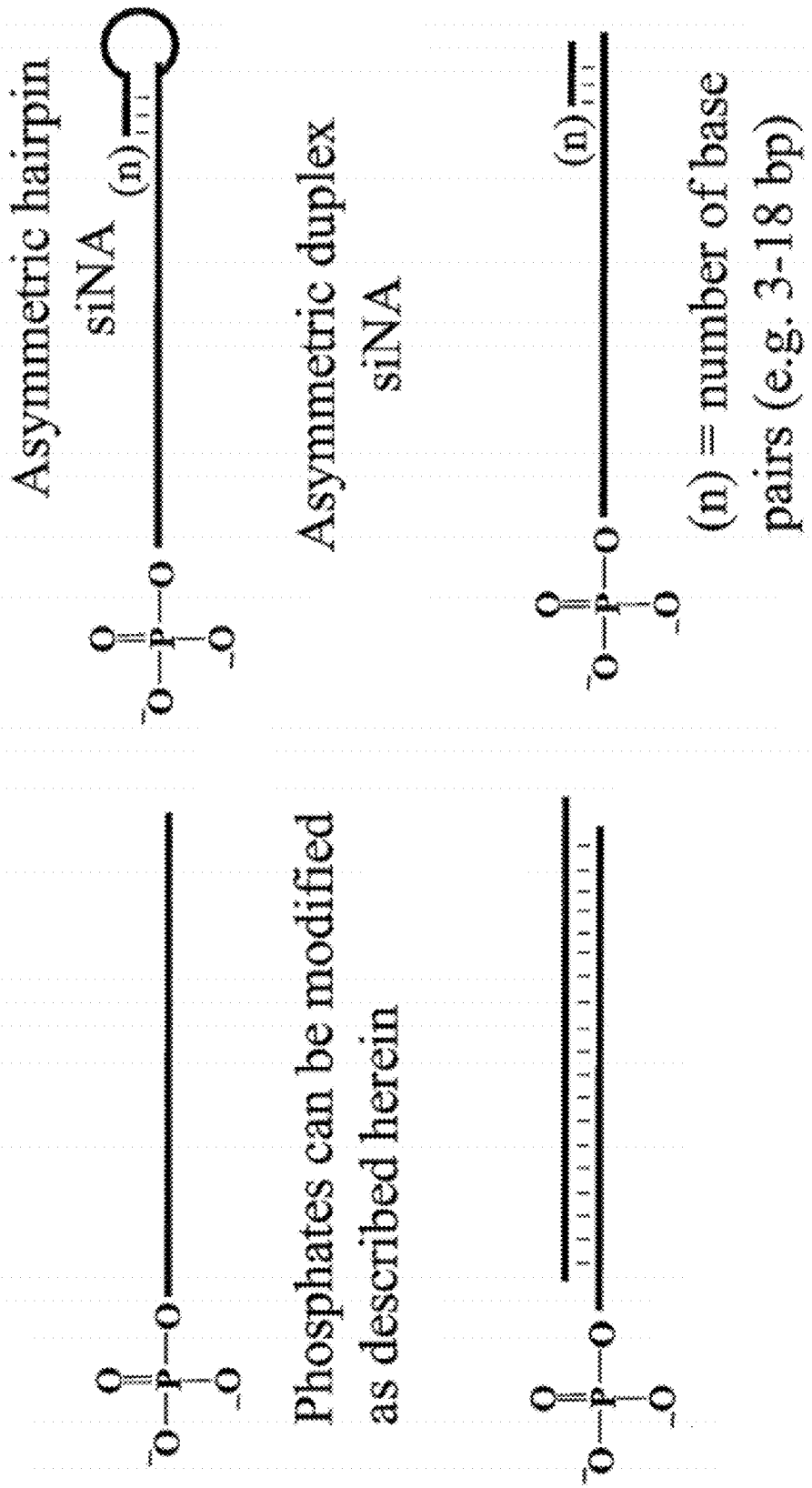
Figure 12: Phosphorylated siNA constructs

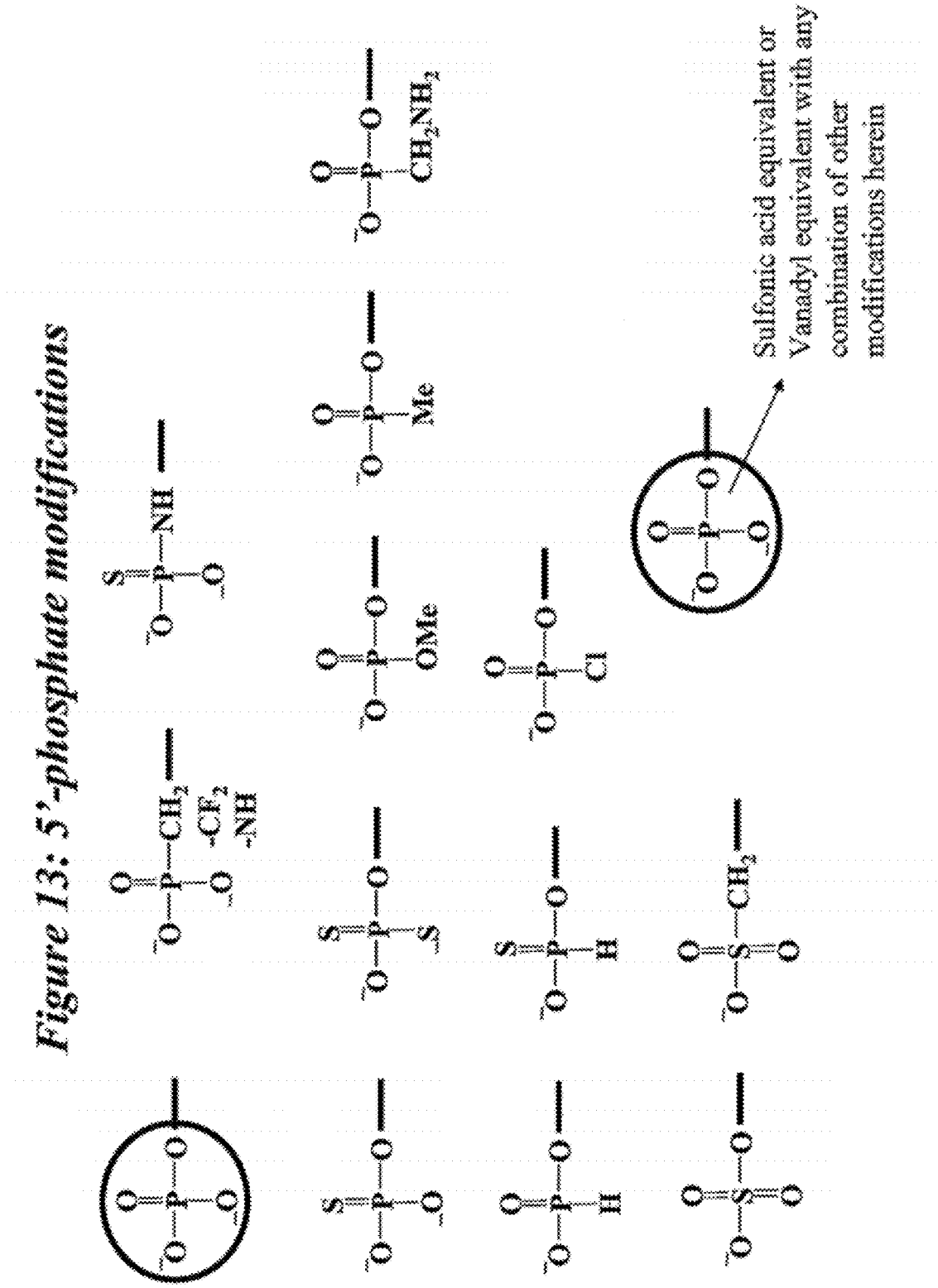
Figure 13: 5'-phosphate modifications

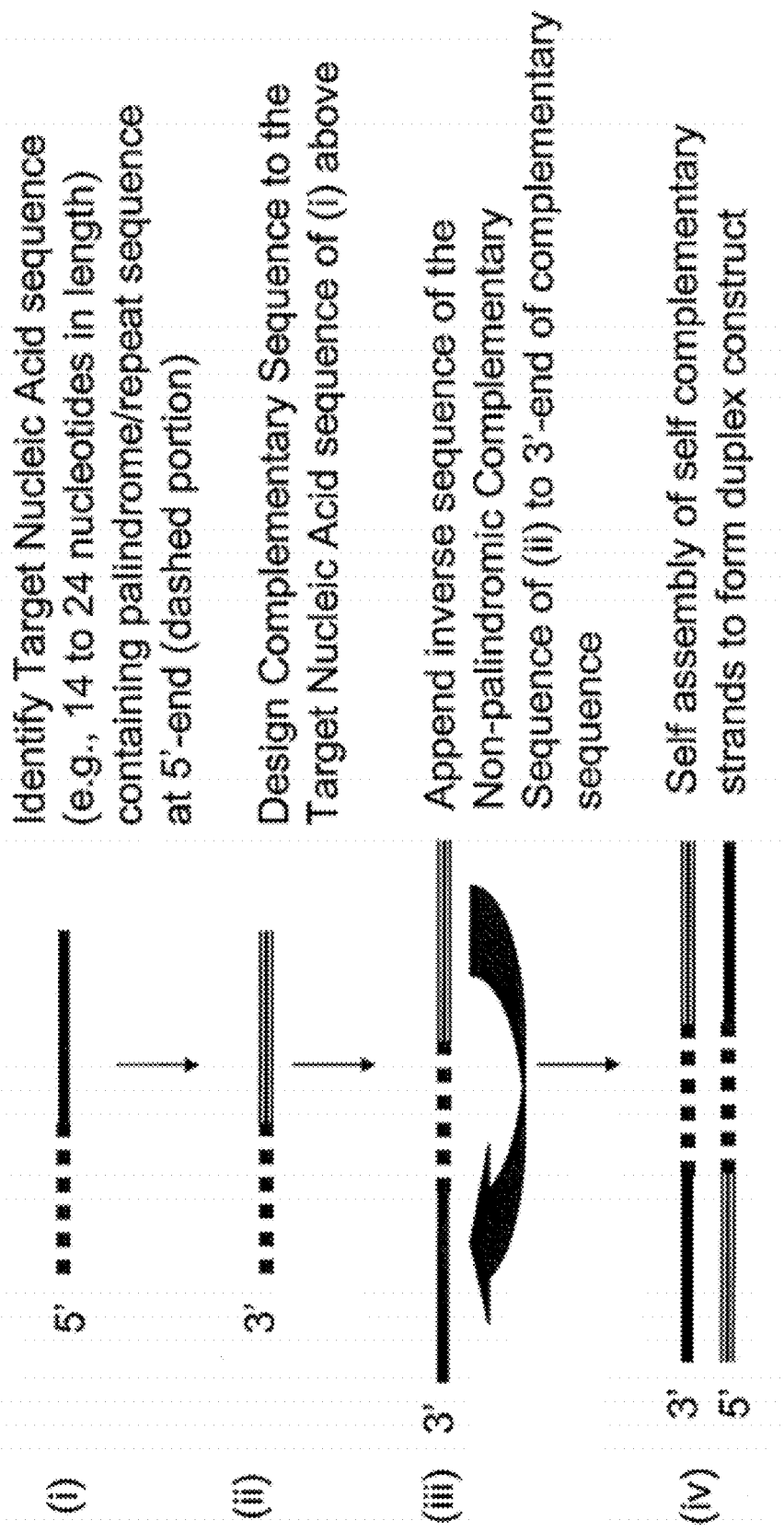

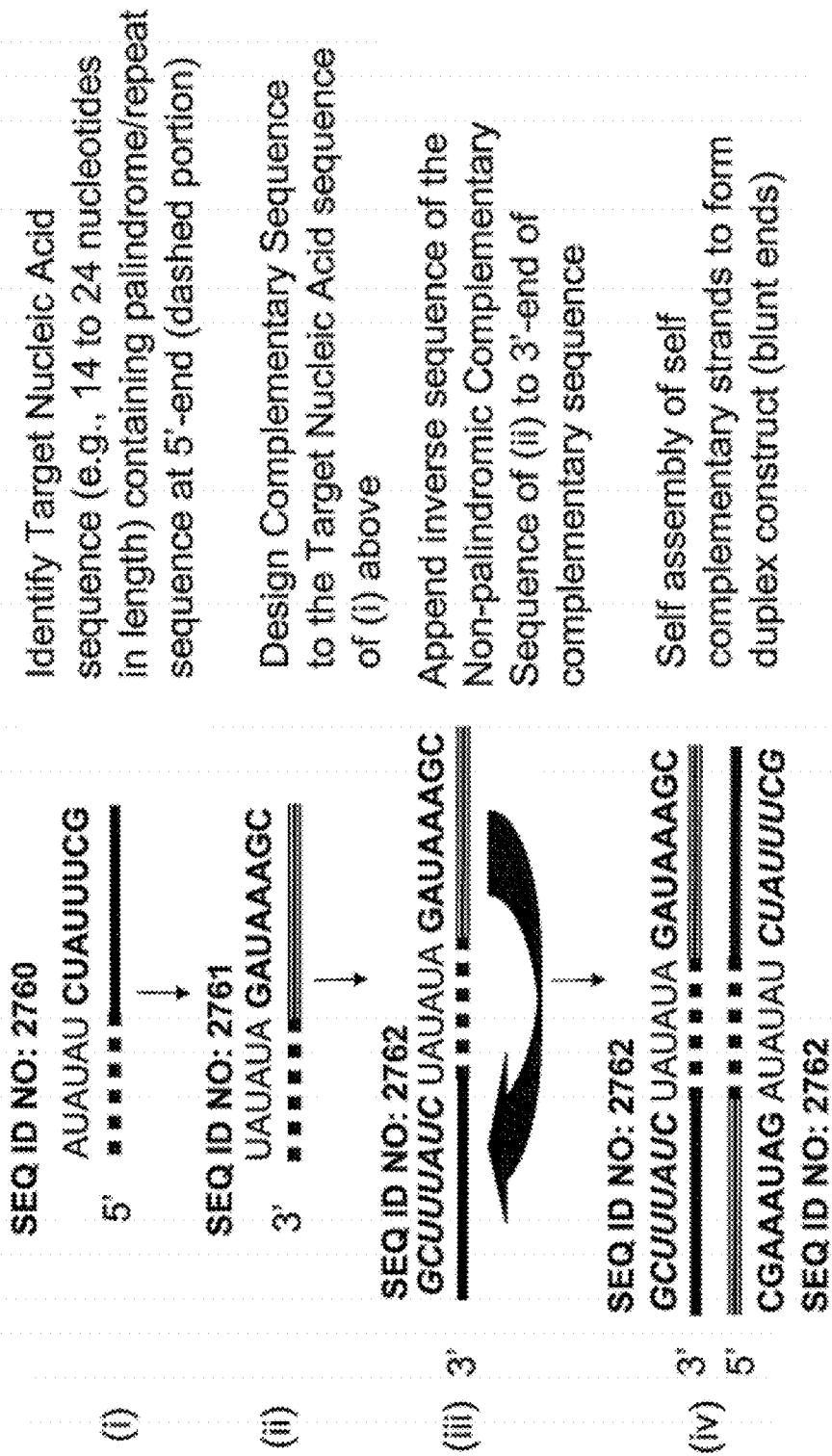
Figure 14B: Example of a duplex forming oligonucleotide sequence that utilizes a palindrome or repeat sequence

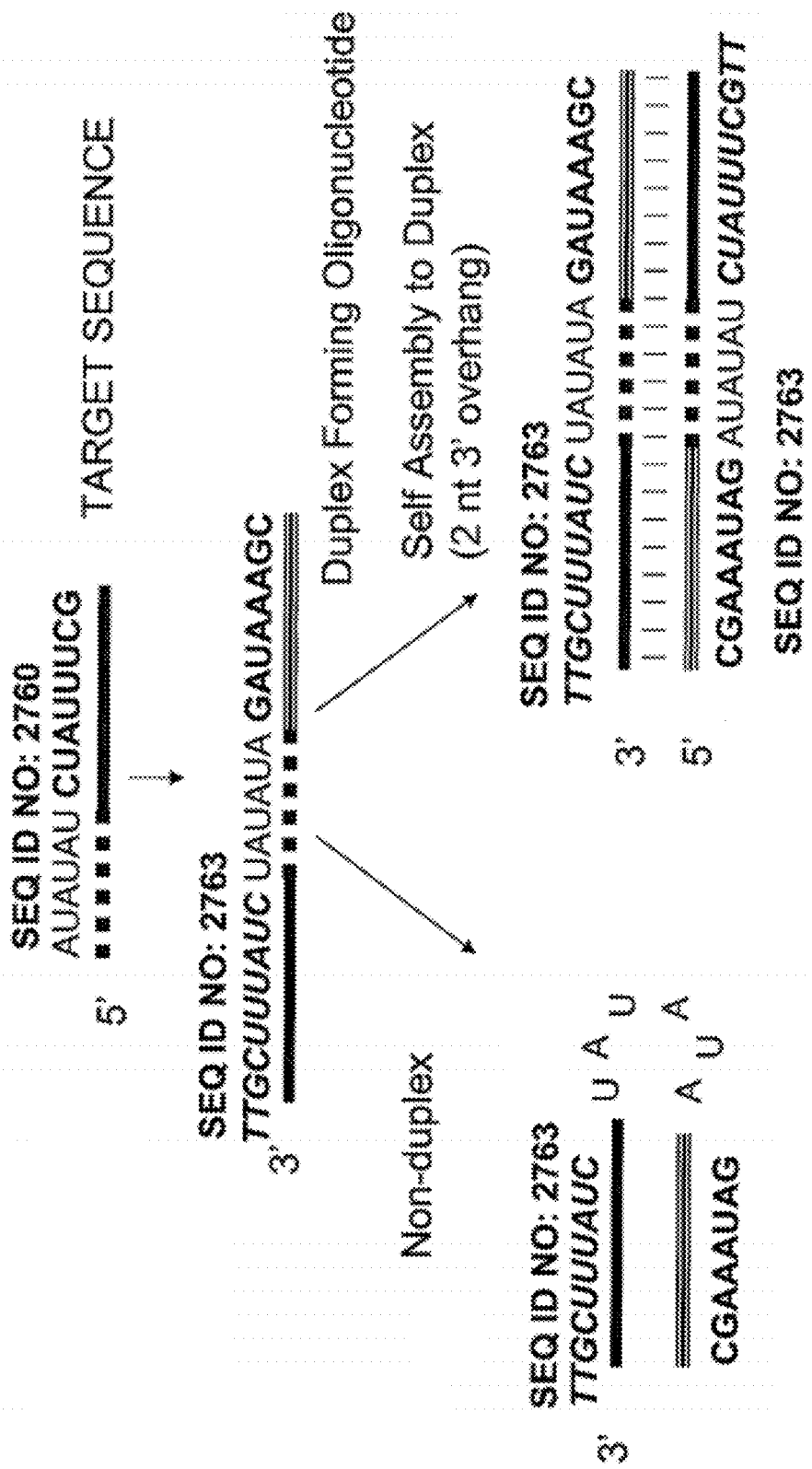
Figure 14C: Example of a duplex forming oligonucleotide sequence that utilizes a palindrome or repeat sequence, self assembly

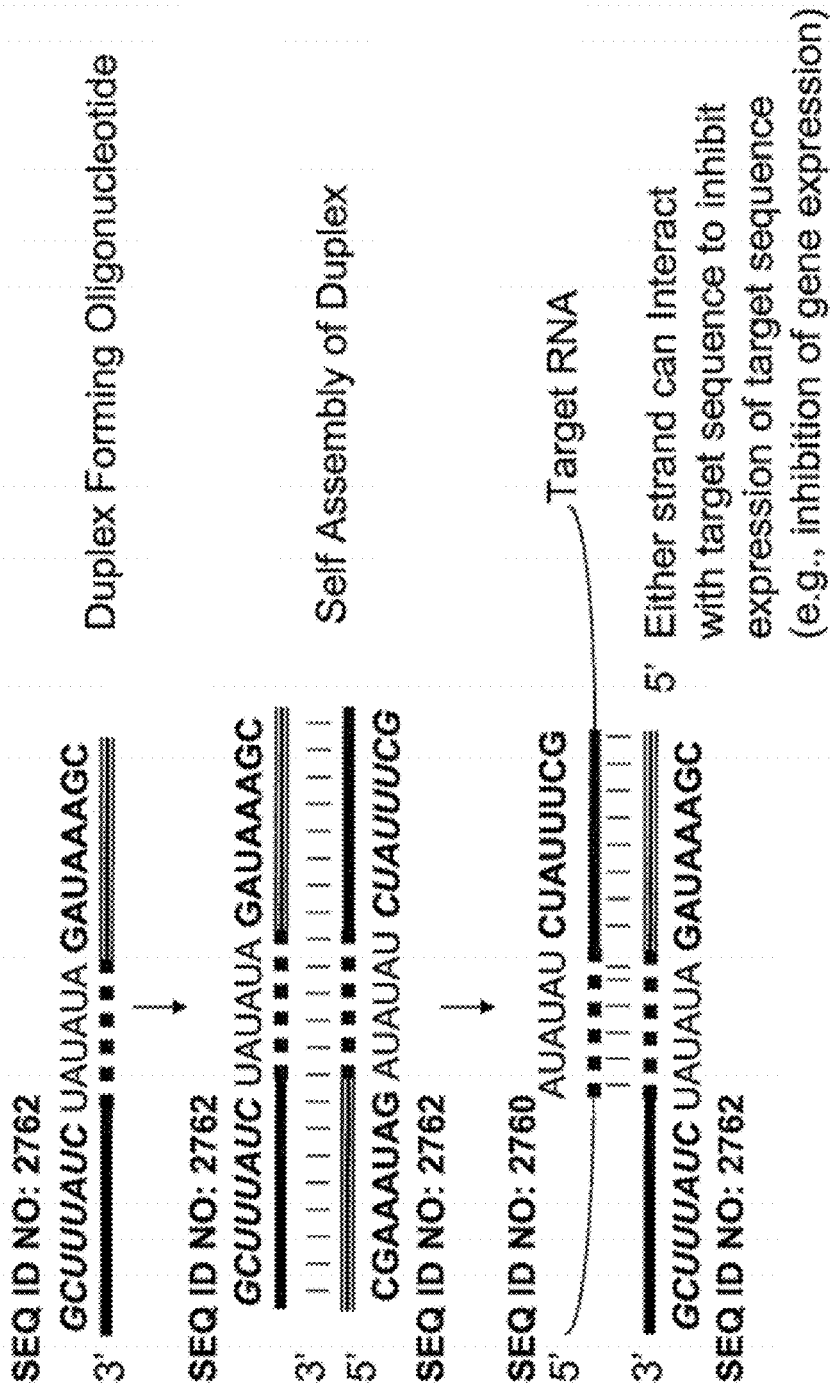
Figure 14D: Example of a duplex forming oligonucleotide sequence that utilizes a palindrome or repeat sequence, self assembly and inhibition of Target Sequence Expression

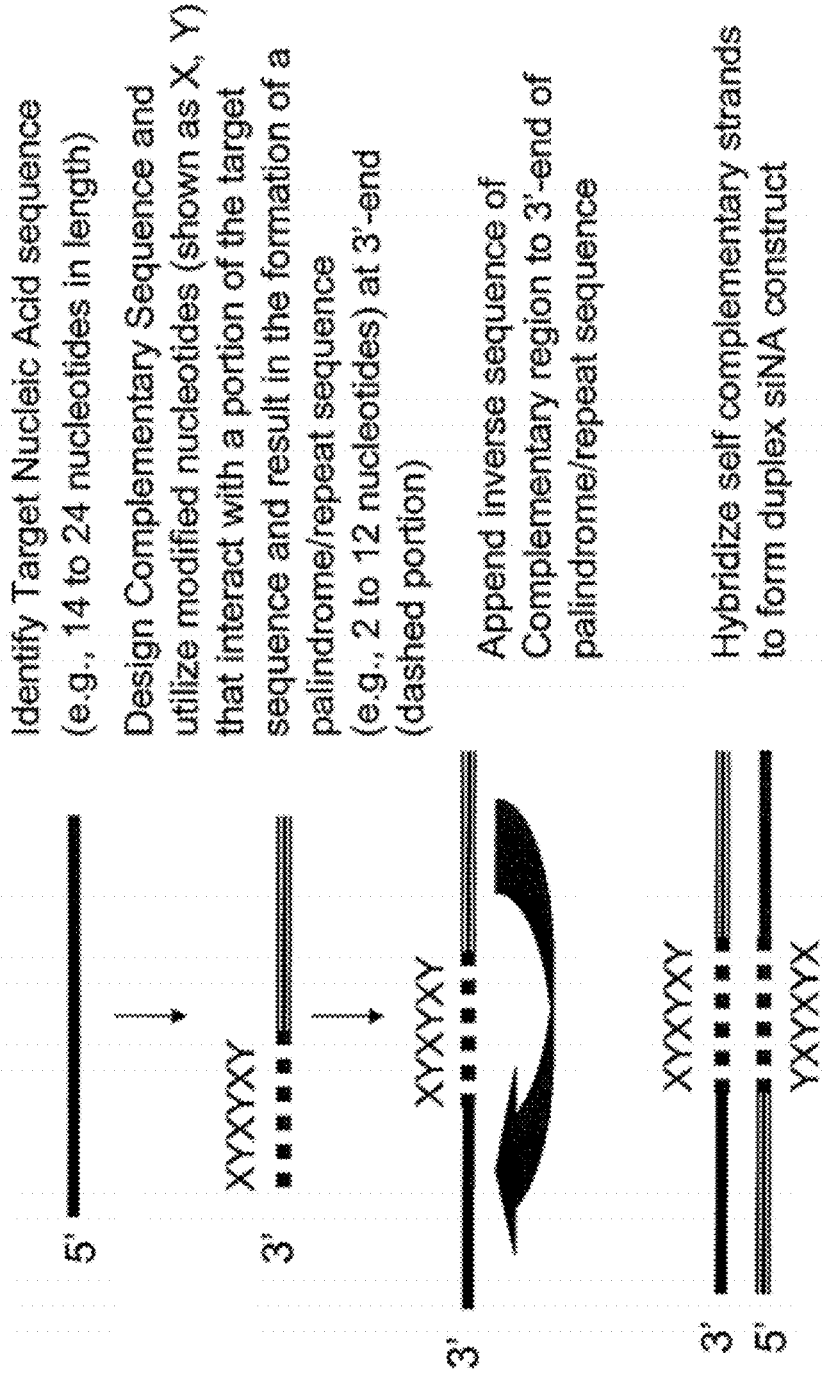
Figure 15: Duplex forming oligonucleotide constructs that utilize artificial palindrome or repeat sequences

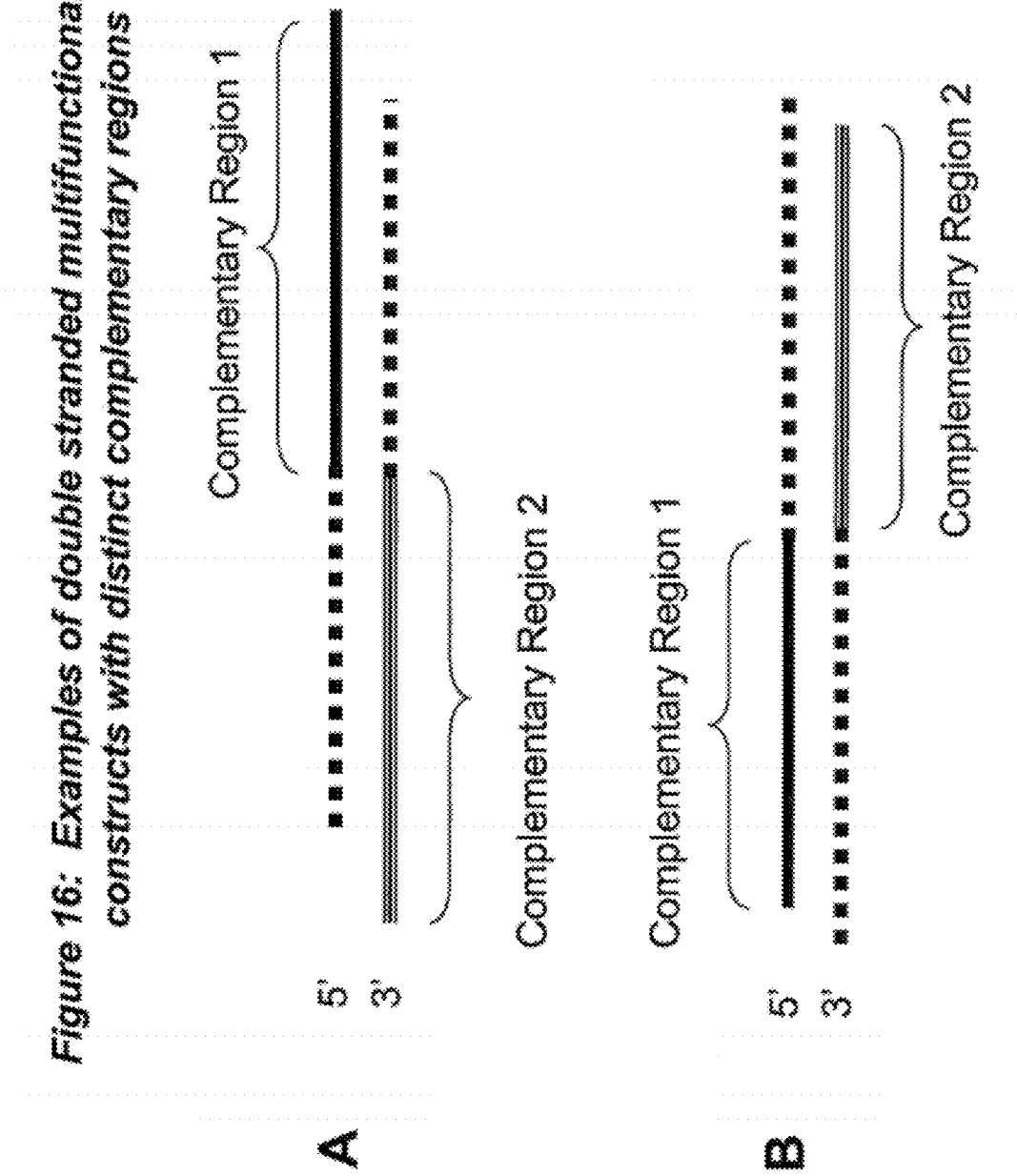

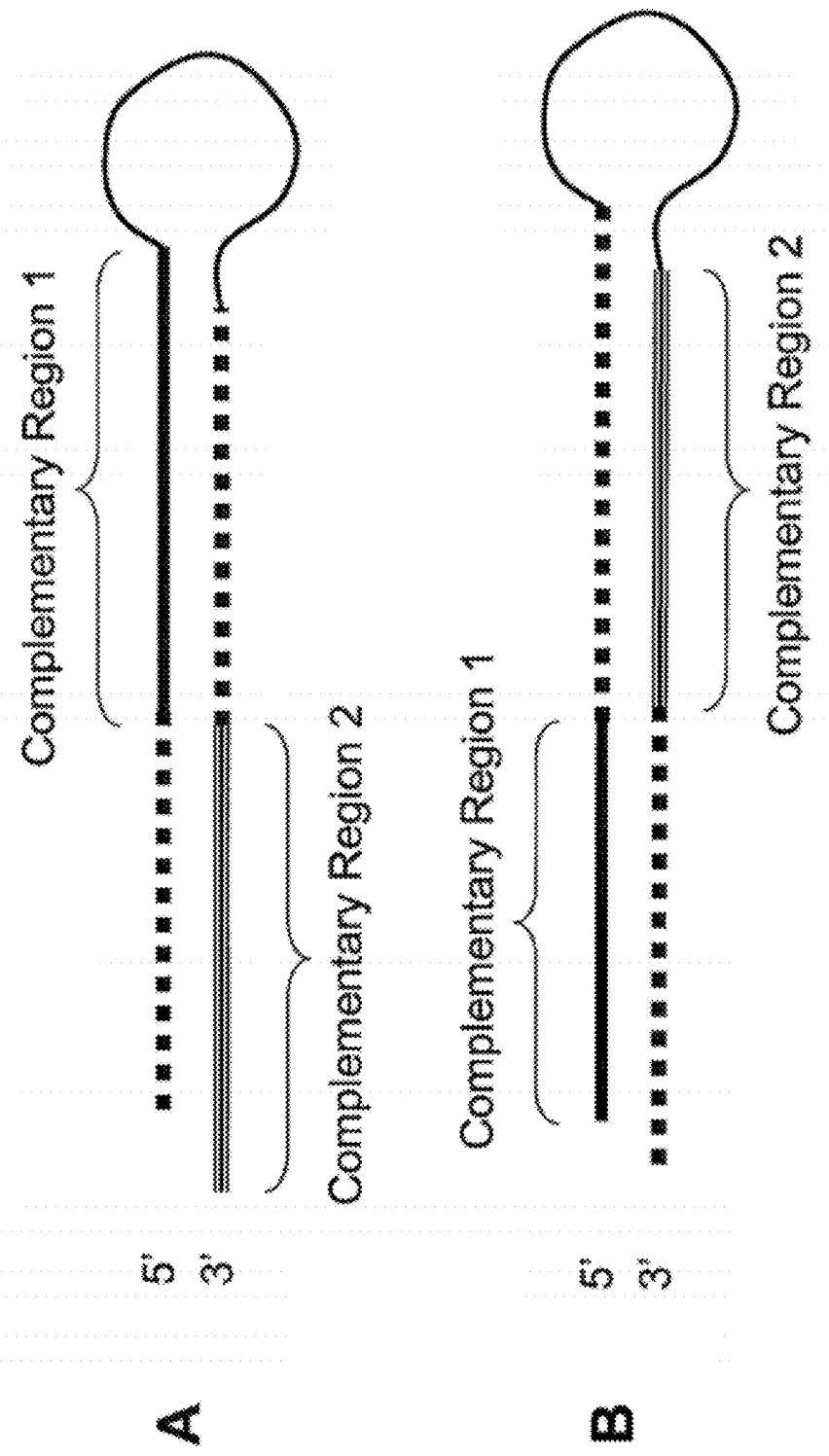
Figure 17: Examples of hairpin multifunctional siNA constructs with distinct complementary regions

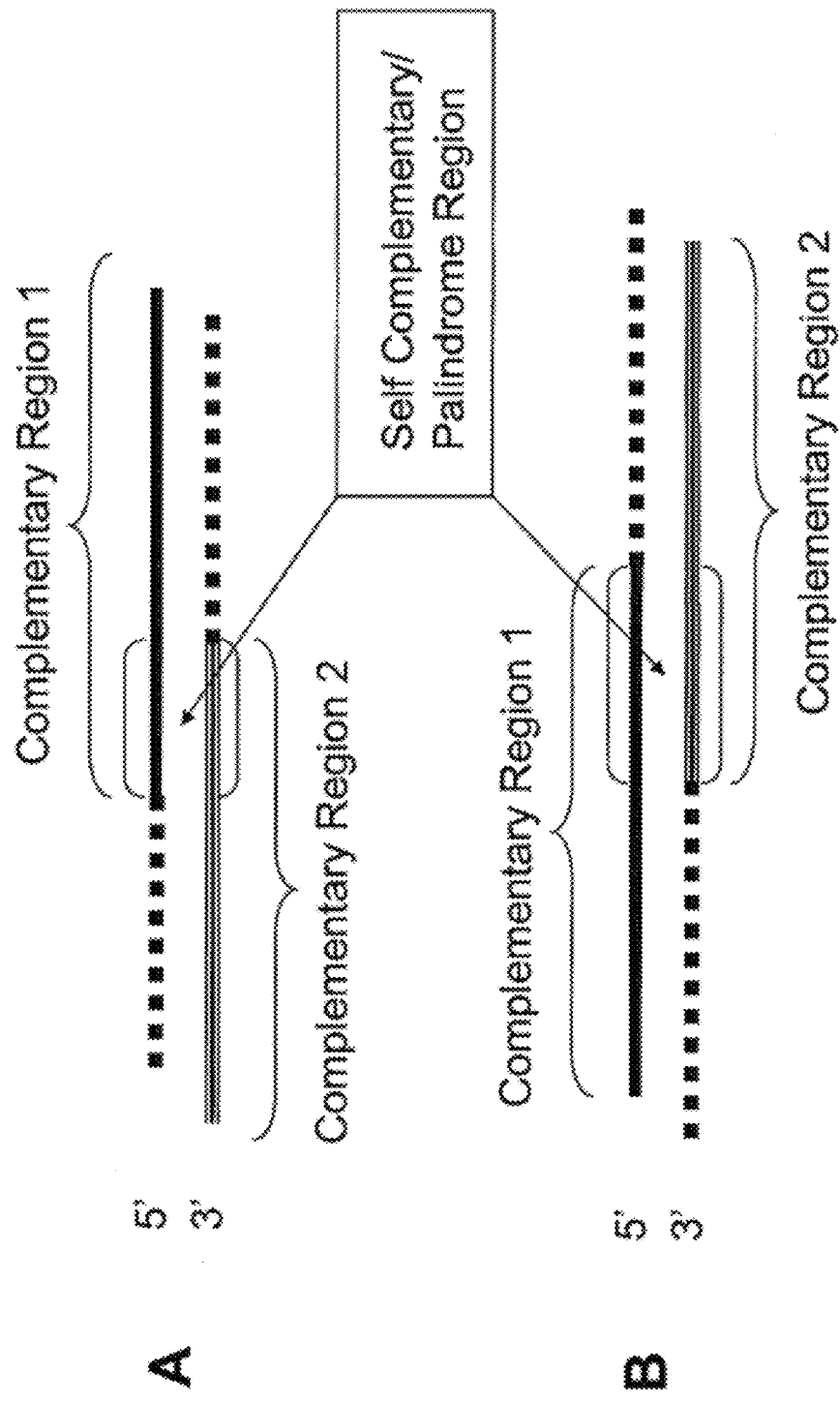
Figure 18: Examples of double stranded multifunctional siNA constructs with distinct complementary regions and a self complementary/palindrome region

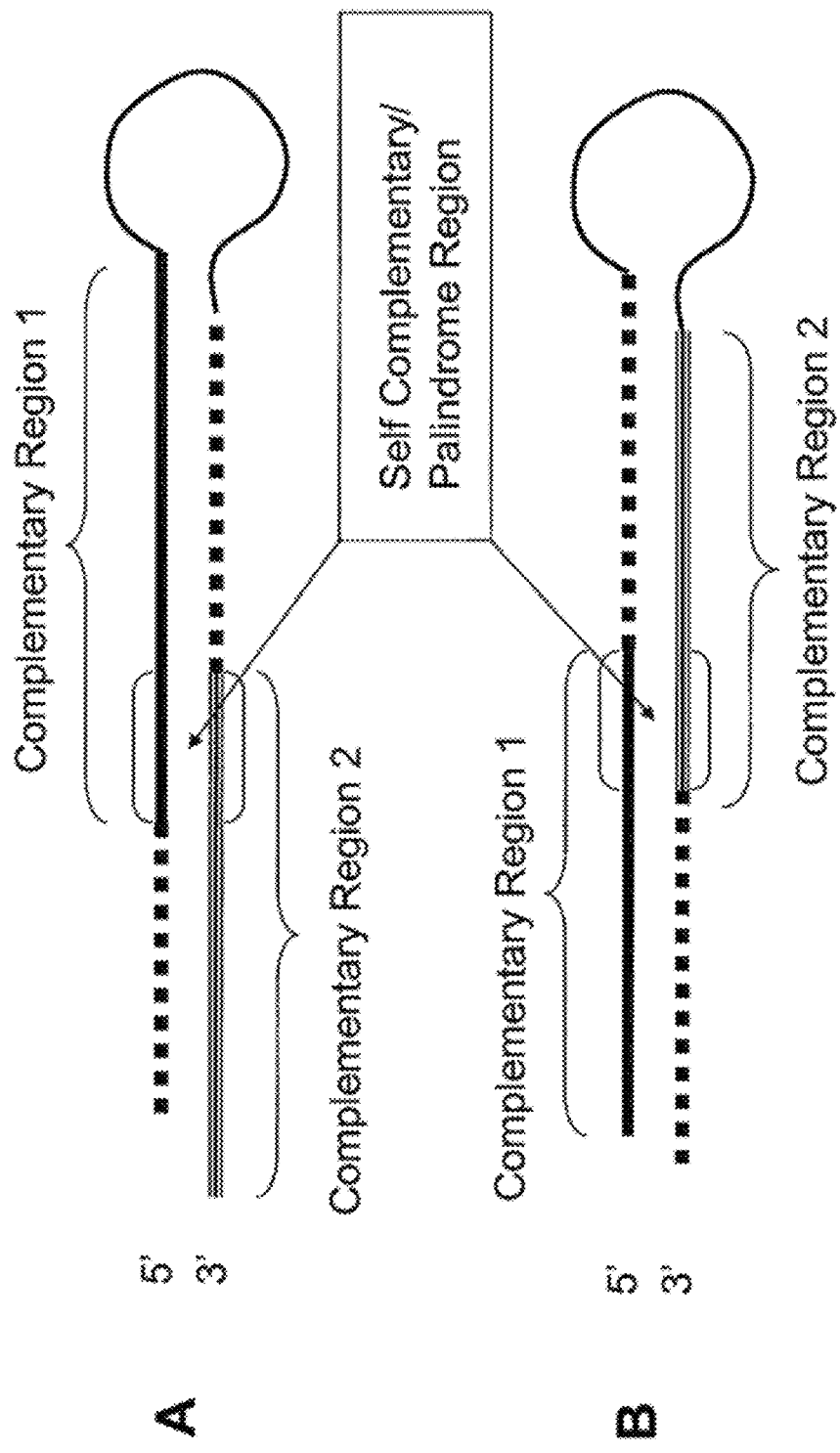
Figure 19: Examples of hairpin multifunctional siNA constructs with distinct complementary regions and a self complementary/palindrome region

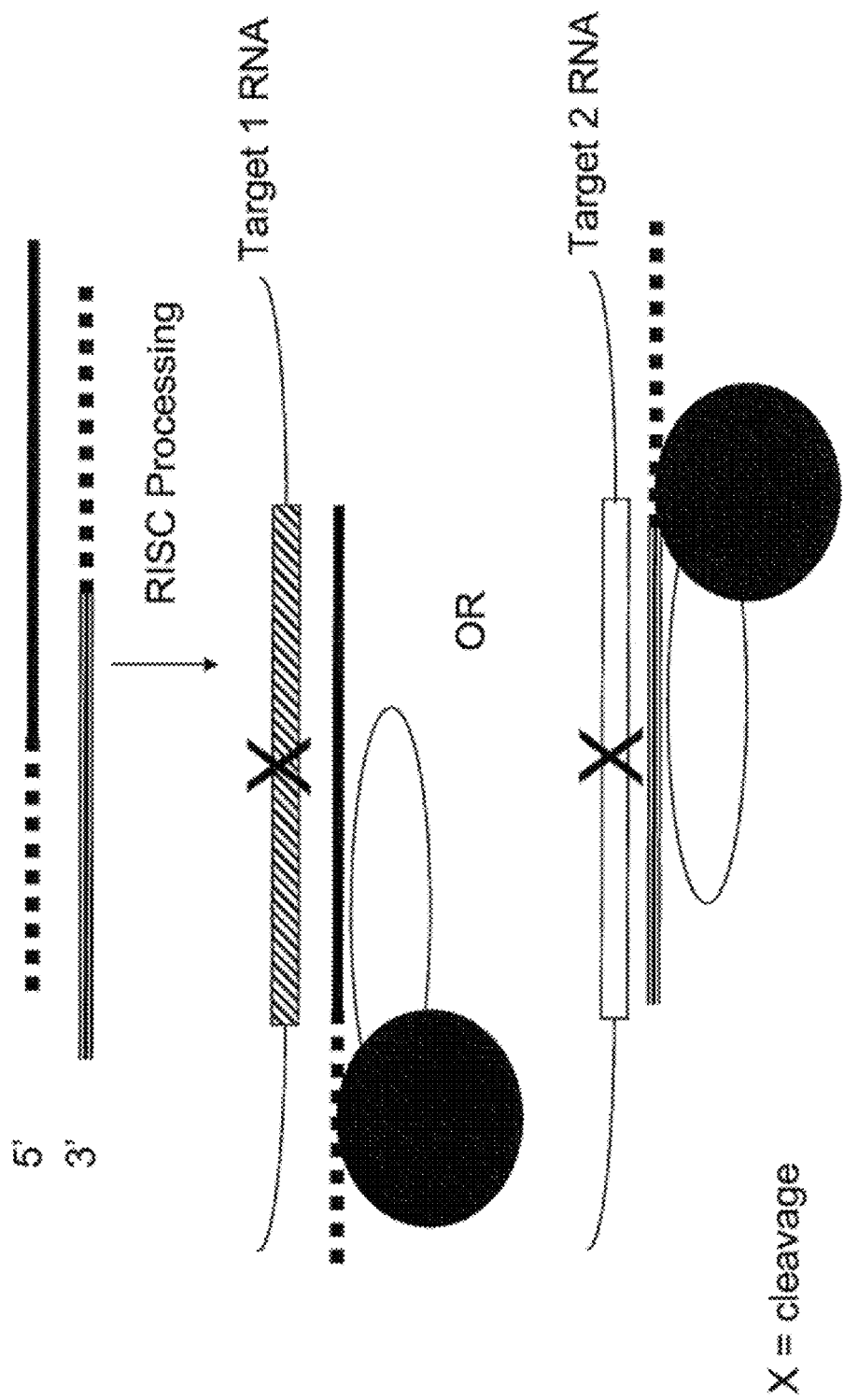

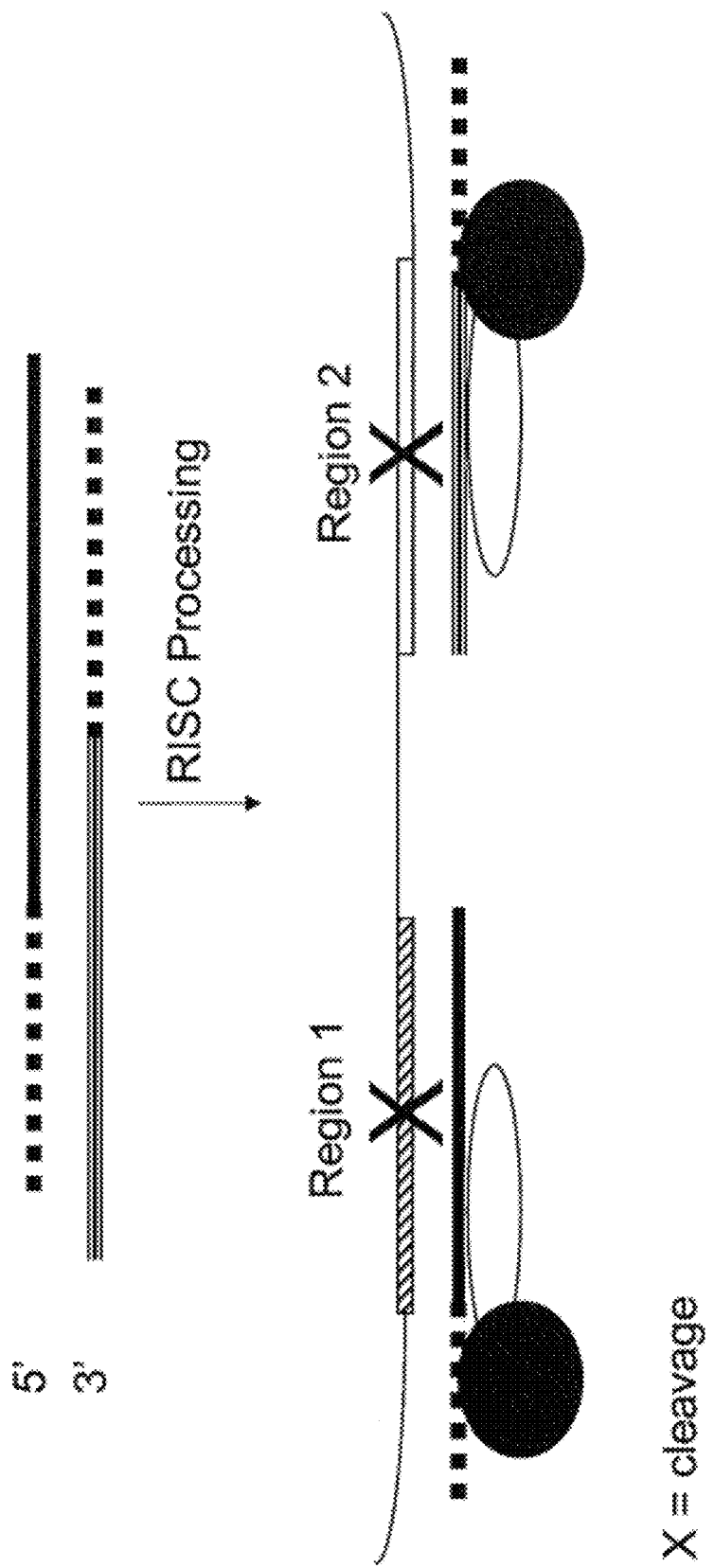
Figure 21: Example of multifunctional siNA targeting two regions within the same target nucleic acid sequence

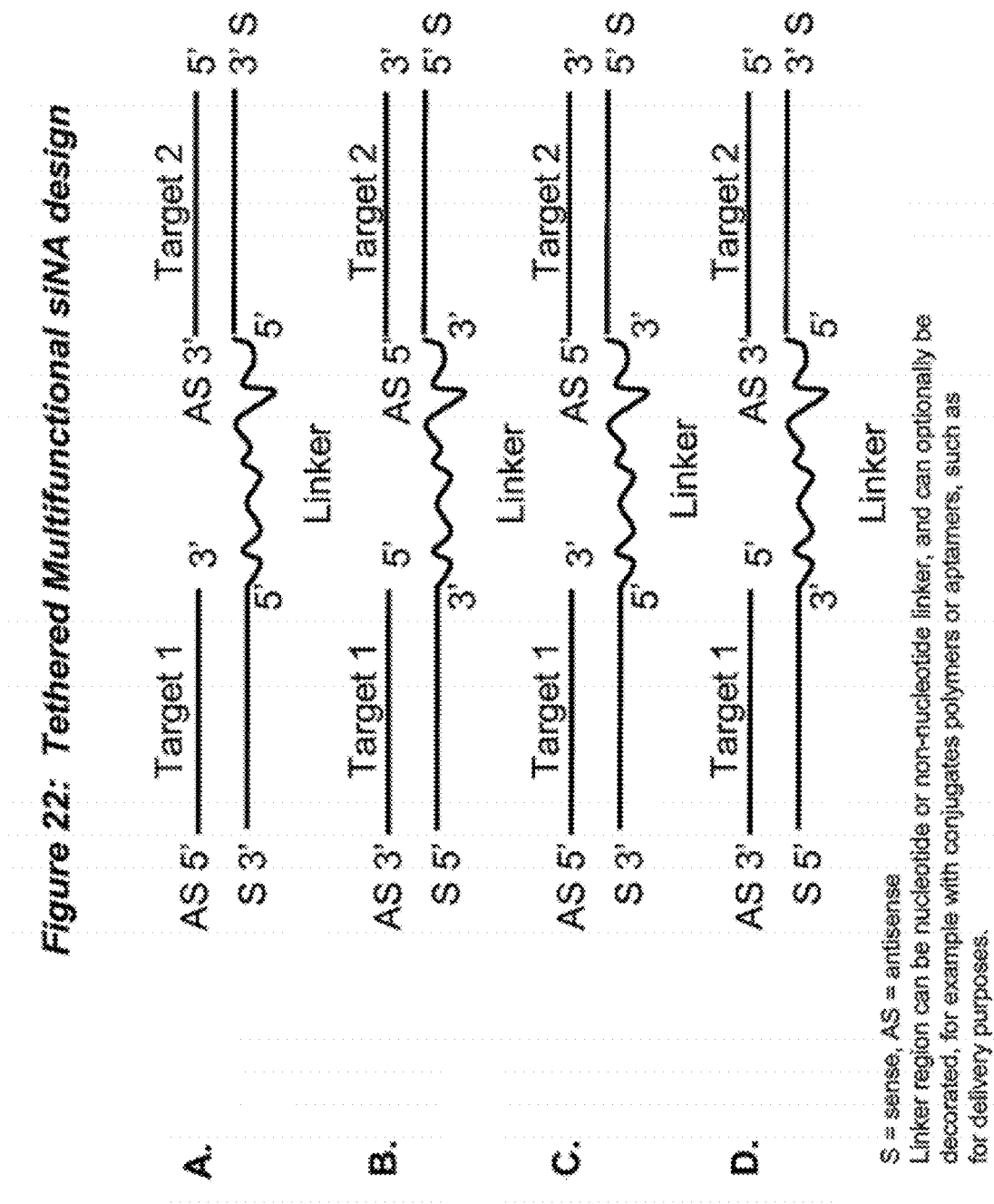
Figure 22: Tethered Multifunctional siNA design

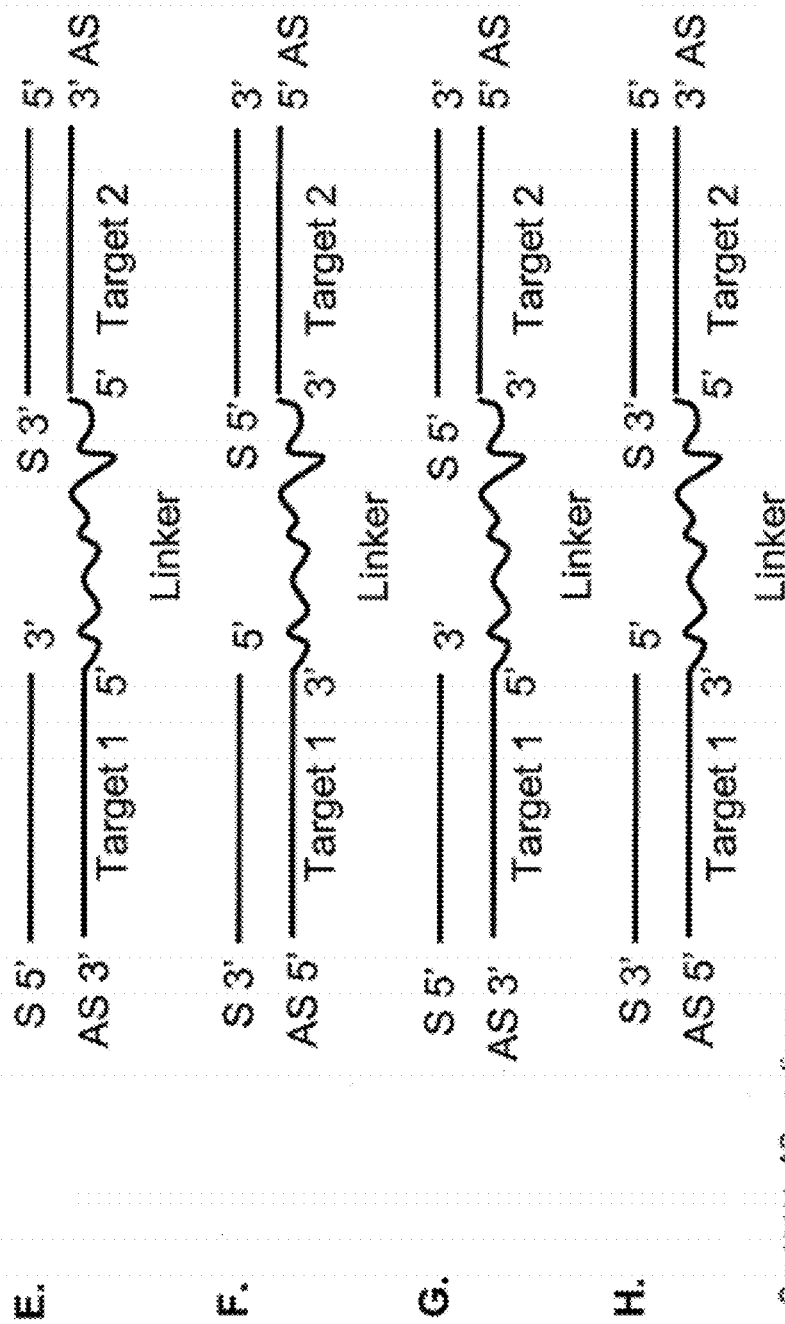

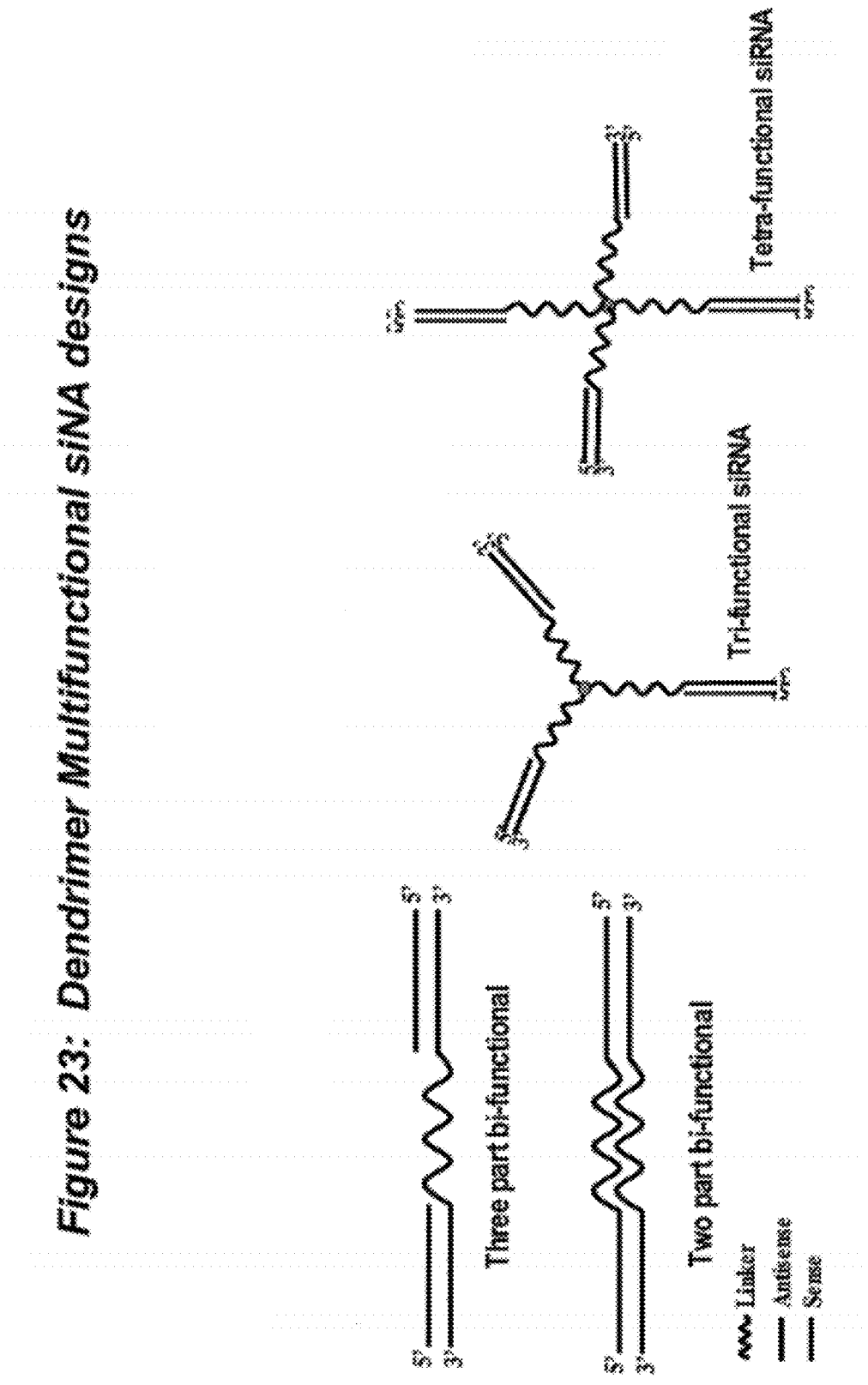

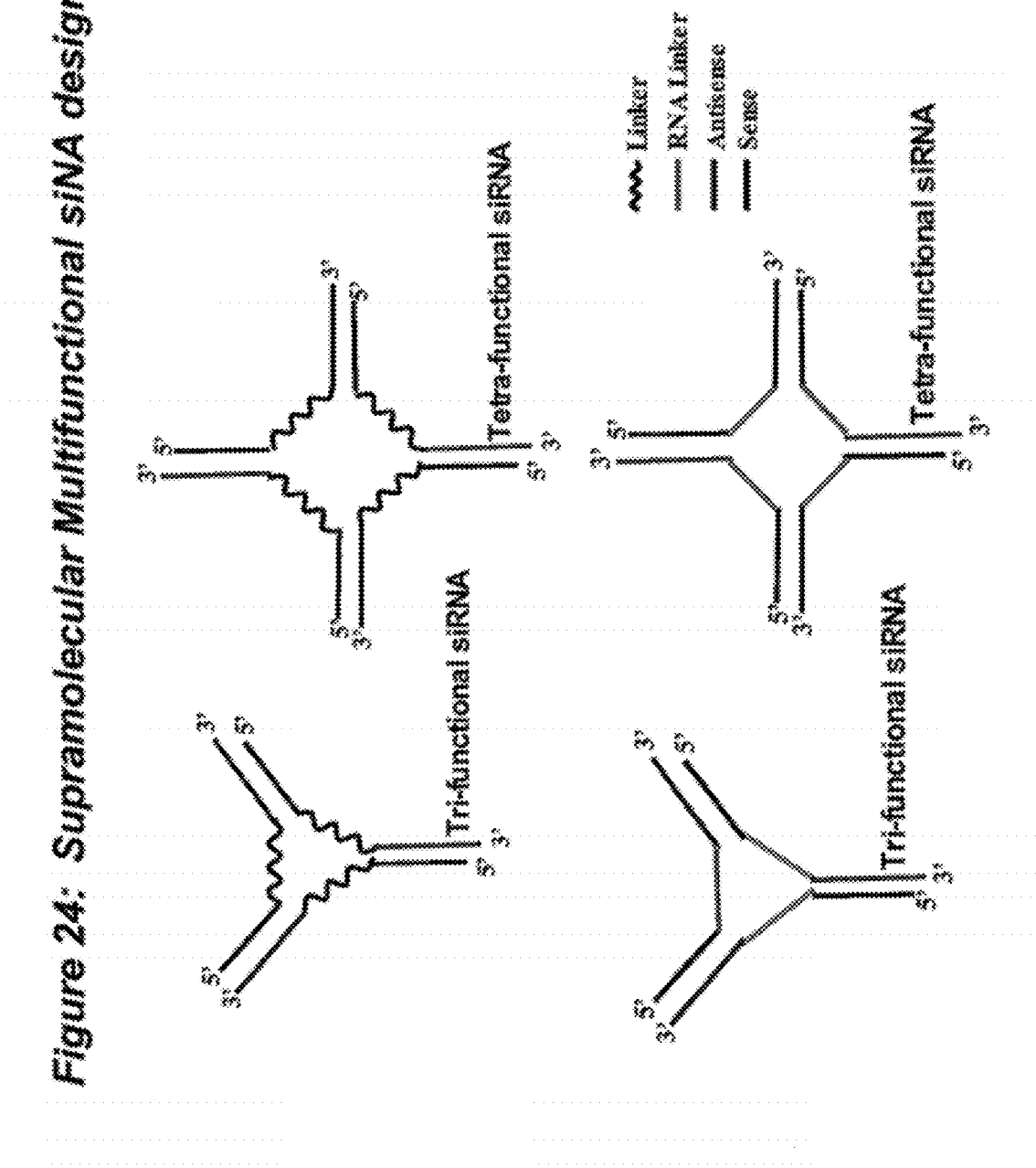
Figure 24: Supramolecular Multifunctional siNA designs

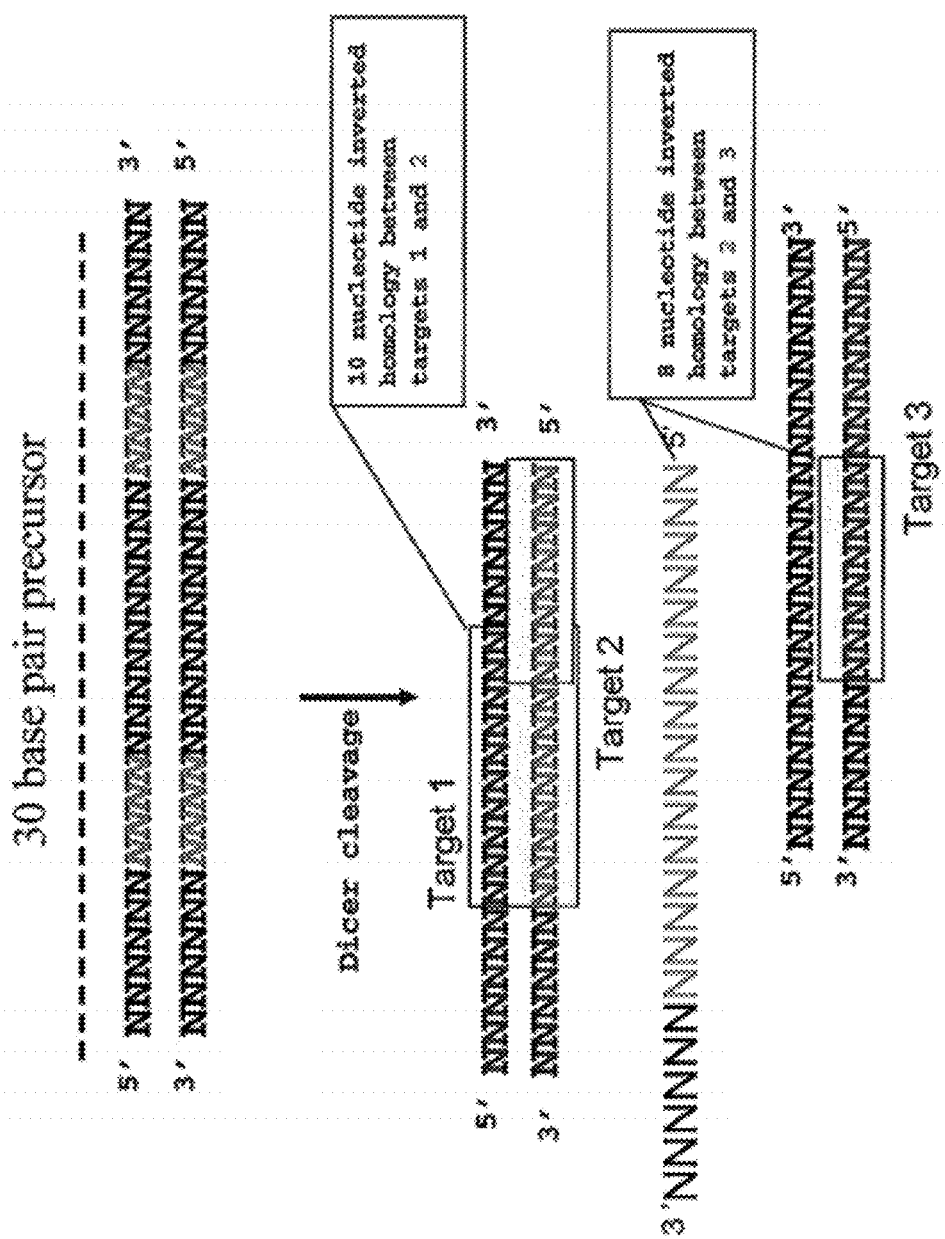

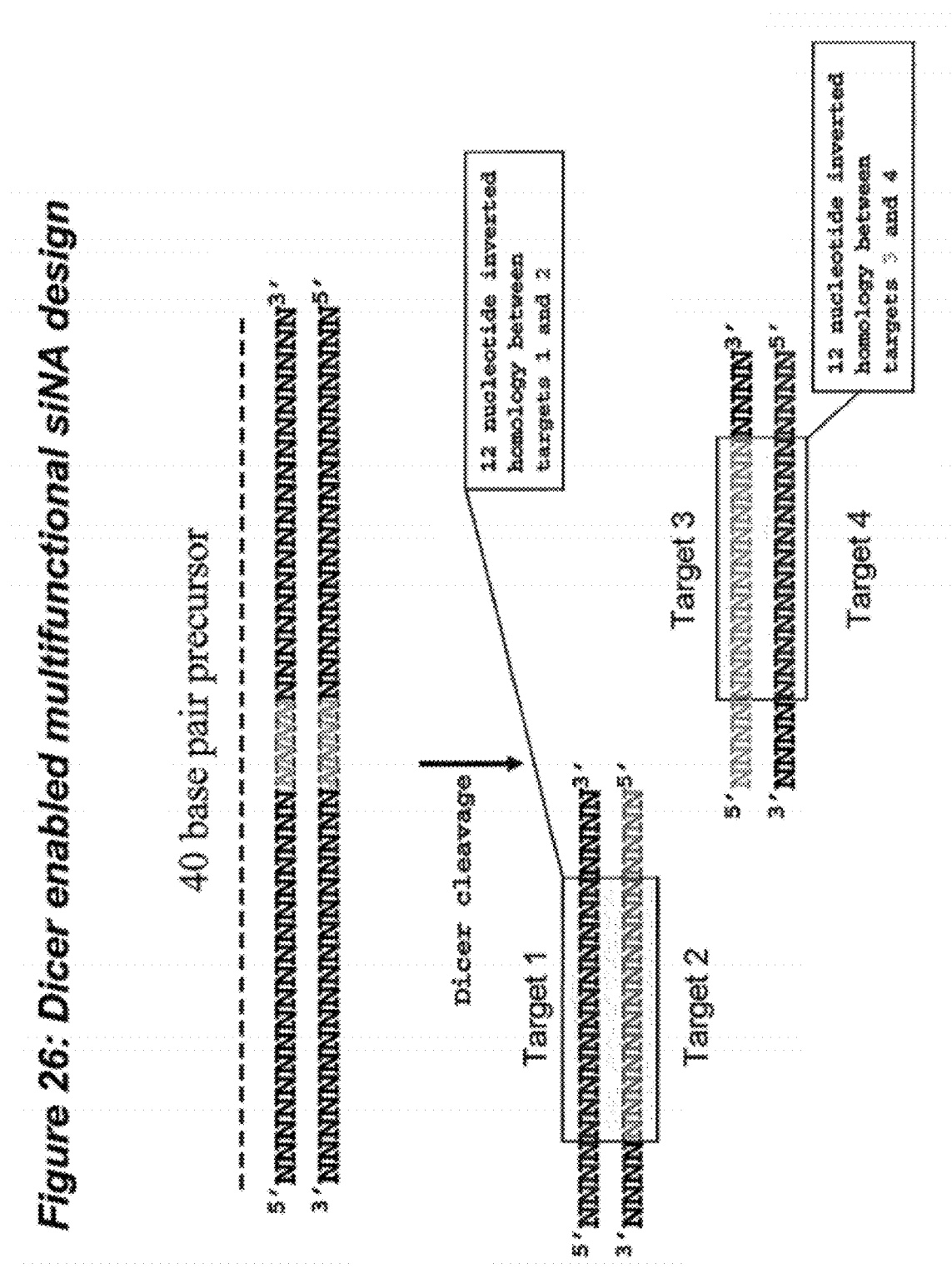

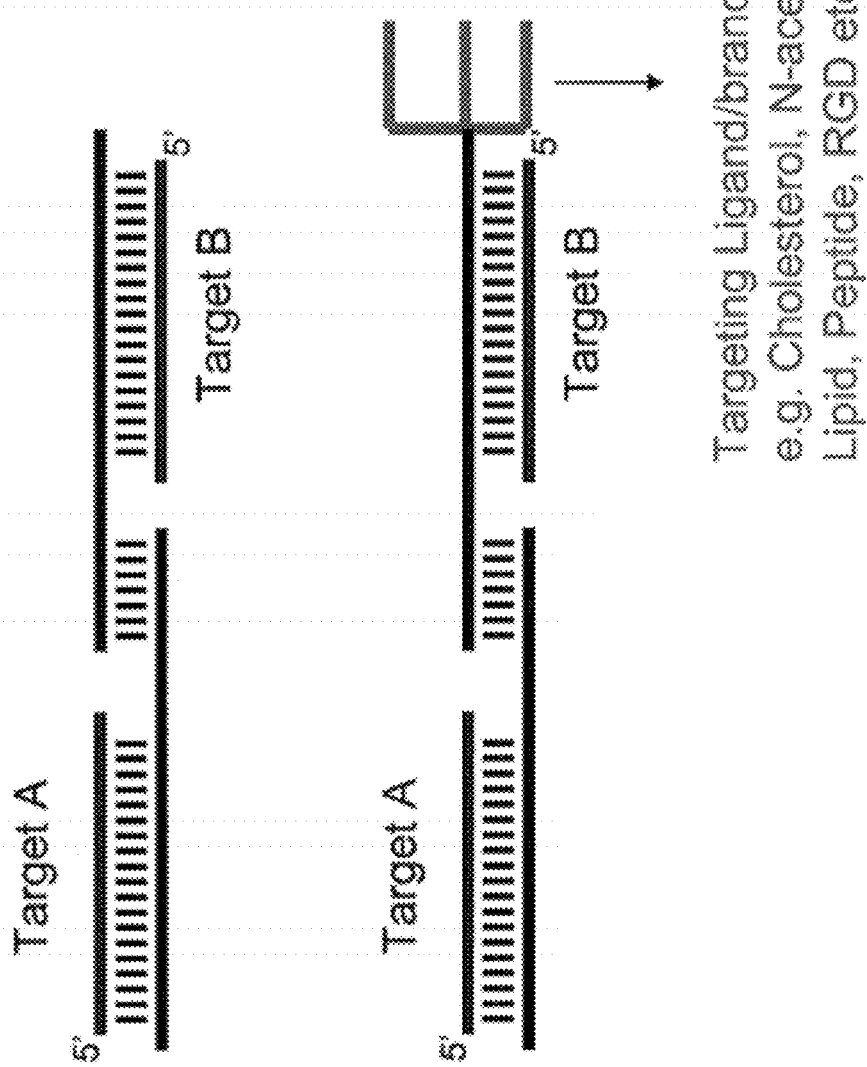
Figure 27: Additional Multifunctional siNA designs

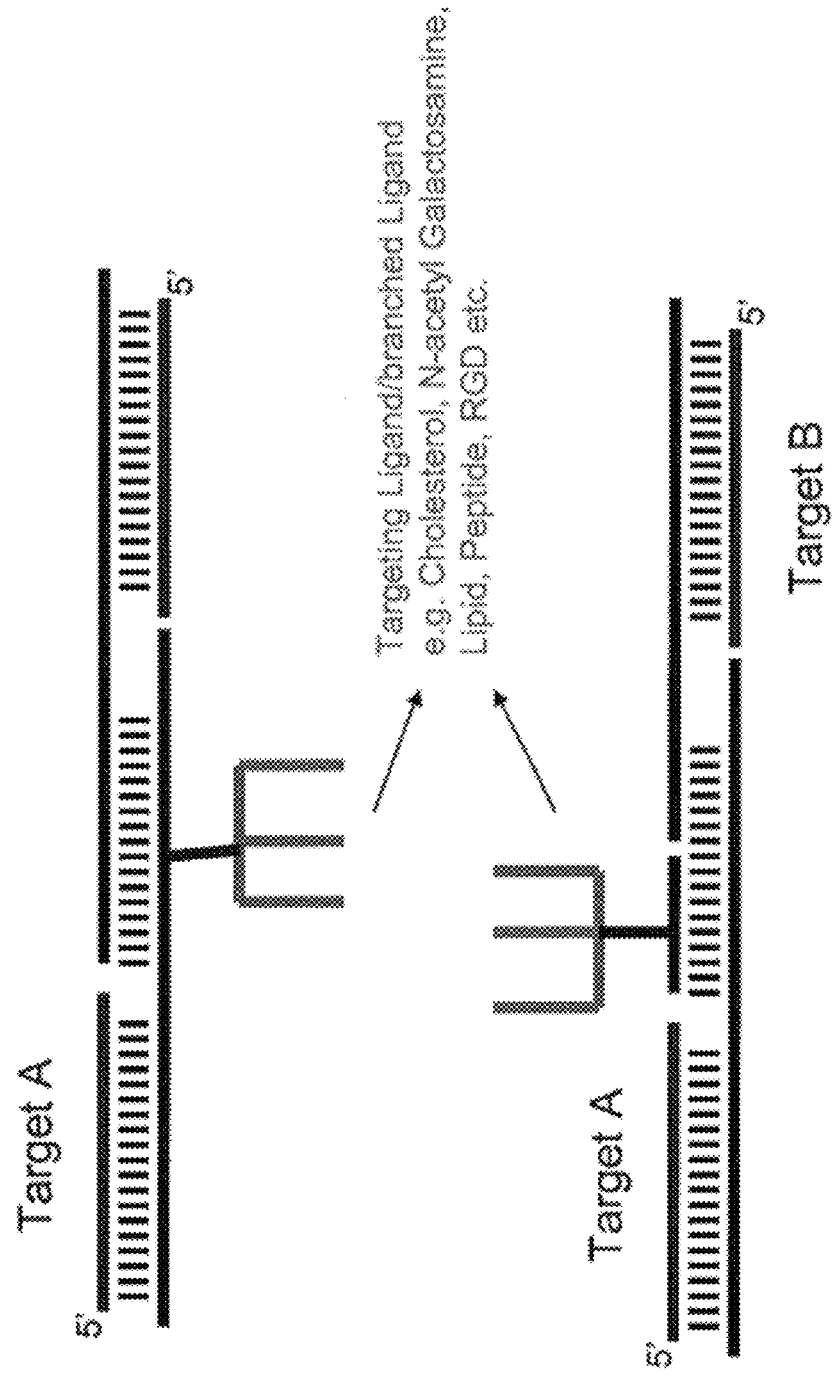
Figure 28: Additional Multifunctional siNA designs

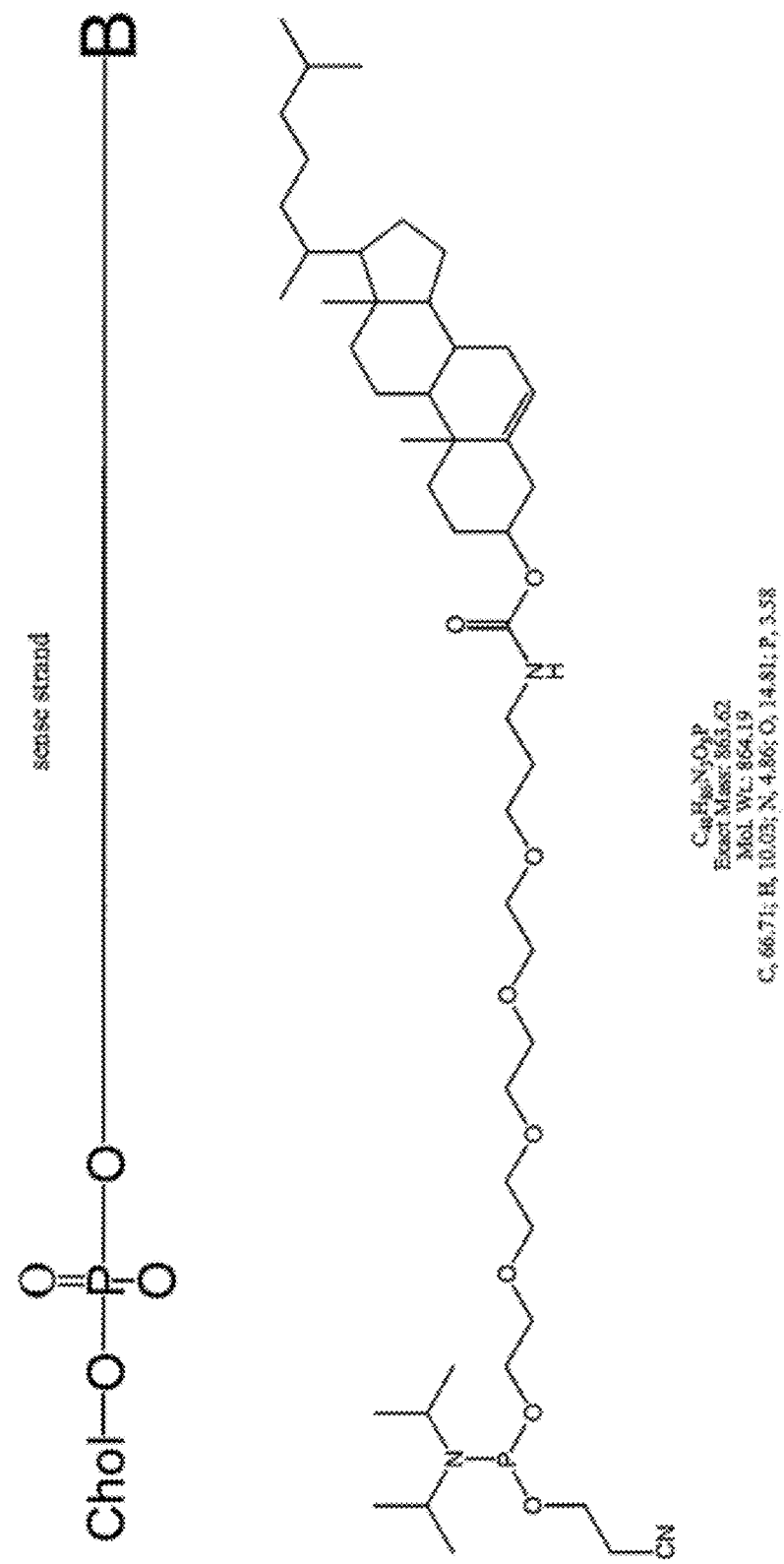
*Figure 29: Cholesterol Conjugate Approach*

US 8,258,288 B2

RNA INTERFERENCE MEDIATED INHIBITION OF RESPIRATORY SYNCYTIAL VIRUS (RSV) EXPRESSION USING SHORT INTERFERING NUCLEIC ACID (SINA)

This application is a continuation of U.S. patent application Ser. No. 11/395,833, filed Mar. 31, 2006 (now abandoned), which is a continuation-in-part of U.S. patent application Ser. No. 11/369,108, filed Mar. 6, 2006 (now abandoned), which is a continuation-in-part of U.S. patent application Ser. No. 10/923,536, filed Aug. 20, 2004 (now abandoned), which is a continuation-in-part of International Patent Application No. PCT/US04/16390, filed May 24, 2004, which is a continuation-in-part of U.S. patent application Ser. No. 10/826,966, filed Apr. 16, 2004 (now abandoned), which is continuation-in-part of U.S. patent application Ser. No. 10/757,803, filed Jan. 14, 2004, which is a continuation-in-part of U.S. patent application Ser. No. 10/720,448, filed Nov. 24, 2003, which is a continuation-in-part of U.S. patent application Ser. No. 10/693,059, filed Oct. 23, 2003 (now abandoned), which is a continuation-in-part of U.S. patent application Ser. No. 10/444,853, filed May 23, 2003, which is a continuation-in-part of International Patent Application No. PCT/US03/05346, filed Feb. 20, 2003, and a continuation-in-part of International Patent Application No. PCT/US03/05028, filed Feb. 20, 2003, both of which claim the benefit of U.S. Provisional Application No. 60/358,580 filed Feb. 20, 2002, U.S. Provisional Application No. 60/363,124 filed Mar. 11, 2002, U.S. Provisional Application No. 60/386,782 filed Jun. 6, 2002, U.S. Provisional Application No. 60/406,784 filed Aug. 29, 2002, U.S. Provisional Application No. 60/408,378 filed Sep. 5, 2002, U.S. Provisional Application No. 60/409,293 filed Sep. 9, 2002, and U.S. Provisional Application No. 60/440,129 filed Jan. 15, 2003. The parent U.S. patent application Ser. No. 11/395,833 is also a continuation-in-part of International Patent Application No. PCT/US05/04270, filed Feb. 9, 2005 which claims the benefit of U.S. Provisional Application No. 60/543,480, filed Feb. 10, 2004. The instant application claims the benefit of all the listed applications, which are hereby incorporated by reference herein in their entireties, including the drawings.

SEQUENCE LISTING

The sequence listing submitted via EFS, in compliance with 37 CFR §1.52(e)(5), is incorporated herein by reference. The sequence listing text file submitted via EFS contains the file "SequenceListing54USCNT", created on Oct. 8, 2008, which is 434,294 bytes in size.

FIELD OF THE INVENTION

The present invention relates to compounds, compositions, and methods for the study, diagnosis, and treatment of traits, diseases and conditions that respond to the modulation of respiratory syncytial virus (RSV) gene expression and/or activity. The present invention is also directed to compounds, compositions, and methods relating to traits, diseases and conditions that respond to the modulation of expression and/or activity of genes involved in respiratory syncytial virus (RSV) gene expression pathways or other cellular processes that mediate the maintenance or development of such traits, diseases and conditions. Specifically, the invention relates to double stranded nucleic acid molecules including small nucleic acid molecules, such as short interfering nucleic acid (siNA), short interfering RNA (siRNA), double-stranded RNA (dsRNA), micro-RNA (miRNA), and short hairpin RNA (shRNA) molecules capable of mediating RNA interference (RNAi) against respiratory syncytial virus (RSV) gene expression. Such small nucleic acid molecules are useful, for example, in providing compositions to prevent, inhibit, or reduce RSV infection, liver failure, hepatocellular carcinoma, cirrhosis, and/or other disease states associated with RSV infection in a subject or organism.

BACKGROUND OF THE INVENTION

The following is a discussion of relevant art pertaining to RNAi. The discussion is provided only for understanding of the invention that follows. The summary is not an admission that any of the work described below is prior art to the claimed invention.

RNA interference refers to the process of sequence-specific post-transcriptional gene silencing in animals mediated by short interfering RNAs (siRNAs) (Zamore et al., 2000, Cell, 101, 25-33; Fire et al., 1998, Nature, 391, 806; Hamilton et al., 1999, Science, 286, 950-951; Lin et al., 1999, Nature, 402, 128-129; Sharp, 1999, Genes & Dev., 13:139-141; and Strauss, 1999, Science, 286, 886). The corresponding process in plants (Heifetz et al., International PCT Publication No. WO 99/61631) is commonly referred to as post-transcriptional gene silencing or RNA silencing and is also referred to as quelling in fungi. The process of post-transcriptional gene silencing is thought to be an evolutionarily-conserved cellular defense mechanism used to prevent the expression of foreign genes and is commonly shared by diverse flora and phyla (Fire et al., 1999, Trends Genet., 15, 358). Such protection from foreign gene expression may have evolved in response to the production of double-stranded RNAs (dsRNAs) derived from viral infection or from the random integration of transposon elements into a host genome via a cellular response that specifically destroys homologous single-stranded RNA or viral genomic RNA. The presence of dsRNA in cells triggers the RNAi response through a mechanism that has yet to be fully characterized. This mechanism appears to be different from other known mechanisms involving double stranded RNA-specific ribonucleases, such as the interferon response that results from dsRNA-mediated activation of protein kinase PKR and 2',5'-oligoadenylate synthetase resulting in non-specific cleavage of mRNA by ribonuclease L (see for example U.S. Pat. Nos. 6,107,094; 5,898,031; Clemens et al., 1997, J. Interferon & Cytokine Res., 17, 503-524; Adah et al., 2001, Curr. Med. Chem., 8, 1189).

The presence of long dsRNAs in cells stimulates the activity of a ribonuclease III enzyme referred to as dicer (Bass, 2000, Cell, 101, 235; Zamore et al., 2000, Cell, 101, 25-33; Hammond et al., 2000, Nature, 404, 293). Dicer is involved in the processing of the dsRNA into short pieces of dsRNA known as short interfering RNAs (siRNAs) (Zamore et al., 2000, Cell, 101, 25-33; Bass, 2000, Cell, 101, 235; Berstein et al., 2001, Nature, 409, 363). Short interfering RNAs derived from dicer activity are typically about 21 to about 23 nucleotides in length and comprise about 19 base pair duplexes (Zamore et al., 2000, Cell, 101, 25-33; Elbashir et al., 2001, Genes Dev., 15, 188). Dicer has also been implicated in the excision of 21- and 22-nucleotide small temporal RNAs (stRNAs) from precursor RNA of conserved structure that are implicated in translational control (Hutvagner et al., 2001, Science, 293, 834). The RNAi response also features an endonuclease complex, commonly referred to as an RNA-induced silencing complex (RISC), which mediates cleavage of single-stranded RNA having sequence complementary to the antisense strand of the siRNA duplex. Cleavage of the target RNA takes place in the middle of the region complementary to the antisense strand of the siRNA duplex (Elbashir et al., 2001, *Genes Dev.*, 15, 188).

RNAi has been studied in a variety of systems. Fire et al., 1998, *Nature*, 391, 806, were the first to observe RNAi in *C. elegans*. Bahramian and Zarbl, 1999, *Molecular and Cellular Biology*, 19, 274-283 and Wianny and Goetz, 1999, *Nature Cell Biol.*, 2, 70, describe RNAi mediated by dsRNA in mammalian systems. Hammond et al., 2000, *Nature*, 404, 293, describe RNAi in *Drosophila* cells transfected with dsRNA. Elbashir et al., 2001, *Nature*, 411, 494 and Tuschl et al., International PCT Publication No. WO 01/75164, describe RNAi induced by introduction of duplexes of synthetic 21-nucleotide RNAs in cultured mammalian cells including human embryonic kidney and HeLa cells. Recent work in *Drosophila* embryonic lysates (Elbashir et al., 2001, *EMBO J.*, 20, 6877 and Tuschl et al., International PCT Publication No. WO 01/75164) has revealed certain requirements for siRNA length, structure, chemical composition, and sequence that are essential to mediate efficient RNAi activity. These studies have shown that 21-nucleotide siRNA duplexes are most active when containing 3'-terminal dinucleotide overhangs. Furthermore, complete substitution of one or both siRNA strands with 2'-deoxy (2'-H) or 2'-O-methyl nucleotides abolishes RNAi activity, whereas substitution of the 3'-terminal siRNA overhang nucleotides with 2'-deoxy nucleotides (2'-H) was shown to be tolerated. Single mismatch sequences in the center of the siRNA duplex were also shown to abolish RNAi activity. In addition, these studies also indicate that the position of the cleavage site in the target RNA is defined by the 5'-end of the siRNA guide sequence rather than the 3'-end of the guide sequence (Elbashir et al., 2001, *EMBO J.*, 20, 6877). Other studies have indicated that a 5'-phosphate on the target-complementary strand of a siRNA duplex is required for siRNA activity and that ATP is utilized to maintain the 5'-phosphate moiety on the siRNA (Nykanen et al., 2001, *Cell*, 107, 309).

Studies have shown that replacing the 3'-terminal nucleotide overhanging segments of a 21-mer siRNA duplex having two-nucleotide 3'-overhangs with deoxyribonucleotides does not have an adverse effect on RNAi activity. Replacing up to four nucleotides on each end of the siRNA with deoxyribonucleotides has been reported to be well tolerated, whereas complete substitution with deoxyribonucleotides results in no RNAi activity (Elbashir et al., 2001, *EMBO J.*, 20, 6877 and Tuschl et al., International PCT Publication No. WO 01/75164). In addition, Elbashir et al., supra, also report that substitution of siRNA with 2'-O-methyl nucleotides completely abolishes RNAi activity. Li et al., International PCT Publication No. WO 00/44914, and Beach et al., International PCT Publication No. WO 01/68836 preliminarily suggest that siRNA may include modifications to either the phosphate-sugar backbone or the nucleoside to include at least one of a nitrogen or sulfur heteroatom, however, neither application postulates to what extent such modifications would be tolerated in siRNA molecules, nor provides any further guidance or examples of such modified siRNA. Kreutzer et al., Canadian Patent Application No. 2,359,180, also describe certain chemical modifications for use in dsRNA constructs in order to counteract activation of double-stranded RNA-dependent protein kinase PKR, specifically 2'-amino or 2'-methyl nucleotides, and nucleotides containing a 2'-O or 4'-C methylene bridge. However, Kreutzer et al. similarly fails to provide examples or guidance as to what extent these modifications would be tolerated in dsRNA molecules.

Parrish et al., 2000, *Molecular Cell*, 6, 1077-1087, tested certain chemical modifications targeting the unc-22 gene in *C. elegans* using long (>25 nt) siRNA transcripts. The authors describe the introduction of thiophosphate residues into these siRNA transcripts by incorporating thiophosphate nucleotide analogs with T7 and T3 RNA polymerase and observed that RNAs with two phosphorothioate modified bases also had substantial decreases in effectiveness as RNAi. Further, Parrish et al. reported that phosphorothioate modification of more than two residues greatly destabilized the RNAs in vitro such that interference activities could not be assayed. Id. at 1081. The authors also tested certain modifications at the 2'-position of the nucleotide sugar in the long siRNA transcripts and found that substituting deoxynucleotides for ribonucleotides produced a substantial decrease in interference activity, especially in the case of Uridine to Thymidine and/or Cytidine to deoxy-Cytidine substitutions. Id. In addition, the authors tested certain base modifications, including substituting, in sense and antisense strands of the siRNA, 4-thiouracil, 5-bromouracil, 5-iodouracil, and 3-(aminoallyl)uracil for uracil, and inosine for guanosine. Whereas 4-thiouracil and 5-bromouracil substitution appeared to be tolerated, Parrish reported that inosine produced a substantial decrease in interference activity when incorporated in either strand. Parrish also reported that incorporation of 5-iodouracil and 3-(aminoallyl)uracil in the antisense strand resulted in a substantial decrease in RNAi activity as well.

The use of longer dsRNA has been described. For example, Beach et al., International PCT Publication No. WO 01/68836, describes specific methods for attenuating gene expression using endogenously-derived dsRNA. Tuschl et al., International PCT Publication No. WO 01/75164, describe a *Drosophila* in vitro RNAi system and the use of specific siRNA molecules for certain functional genomic and certain therapeutic applications; although Tuschl, 2001, *Chem. Biochem.*, 2, 239-245, doubts that RNAi can be used to cure genetic diseases or viral infection due to the danger of activating interferon response. Li et al., International PCT Publication No. WO 00/44914, describe the use of specific long (141 bp-488 bp) enzymatically synthesized or vector expressed dsRNAs for attenuating the expression of certain target genes. Zernicka-Goetz et al., International PCT Publication No. WO 01/36646, describe certain methods for inhibiting the expression of particular genes in mammalian cells using certain long (550 bp-714 bp), enzymatically synthesized or vector expressed dsRNA molecules. Fire et al., International PCT Publication No. WO 99/32619, describe particular methods for introducing certain long dsRNA molecules into cells for use in inhibiting gene expression in nematodes. Plaetinck et al., International PCT Publication No. WO 00/01846, describe certain methods for identifying specific genes responsible for conferring a particular phenotype in a cell using specific long dsRNA molecules. Mello et al., International PCT Publication No. WO 01/29058, describe the identification of specific genes involved in dsRNA-mediated RNAi. Pachuck et al., International PCT Publication No. WO 00/63364, describe certain long (at least 200 nucleotide) dsRNA constructs. Deschamps Depaillette et al., International PCT Publication No. WO 99/07409, describe specific compositions consisting of particular dsRNA molecules combined with certain anti-viral agents. Waterhouse et al., International PCT Publication No. 99/53050 and 1998, *PNAS*, 95, 13959-13964, describe certain methods for decreasing the phenotypic expression of a nucleic acid in plant cells using certain dsRNAs. Driscoll et al., International PCT Publication No. WO 01/49844, describe specific DNA expression constructs for use in facilitating gene silencing in targeted organisms.

Others have reported on various RNAi and gene-silencing systems. For example, Parrish et al., 2000, *Molecular Cell*, 6, 1077-1087, describe specific chemically-modified dsRNA constructs targeting the unc-22 gene of *C. elegans*. Grossniklaus, International PCT Publication No. WO 01/38551, describes certain methods for regulating polycomb gene expression in plants using certain dsRNAs. Churikov et al., International PCT Publication No. WO 01/42443, describe certain methods for modifying genetic characteristics of an organism using certain dsRNAs. Cogoni et al, International PCT Publication No. WO 01/53475, describe certain methods for isolating a *Neurospora* silencing gene and uses thereof. Reed et al., International PCT Publication No. WO 01/68836, describe certain methods for gene silencing in plants. Honer et al., International PCT Publication No. WO 01/70944, describe certain methods of drug screening using transgenic nematodes as Parkinson's Disease models using certain dsRNAs. Deak et al., International PCT Publication No. WO 01/72774, describe certain *Drosophila*-derived gene products that may be related to RNAi in *Drosophila*. Arndt et al., International PCT Publication No. WO 01/92513 describe certain methods for mediating gene suppression by using factors that enhance RNAi. Tuschl et al., International PCT Publication No. WO 02/44321, describe certain synthetic siRNA constructs. Pachuk et al., International PCT Publication No. WO 00/63364, and Satishchandran et al., International PCT Publication No. WO 01/04313, describe certain methods and compositions for inhibiting the function of certain polynucleotide sequences using certain long (over 250 bp), vector expressed dsRNAs. Echeverri et al., International PCT Publication No. WO 02/38805, describe certain *C. elegans* genes identified via RNAi. Kreutzer et al., International PCT Publications Nos. WO 02/055692, WO 02/055693, and EP 1144623 B1 describes certain methods for inhibiting gene expression using dsRNA. Graham et al., International PCT Publications Nos. WO 99/49029 and WO 01/70949, and AU 4037501 describe certain vector expressed siRNA molecules. Fire et al., U.S. Pat. No. 6,506,559, describe certain methods for inhibiting gene expression in vitro using certain long dsRNA (299 bp-1033 bp) constructs that mediate RNAi. Martinez et al., 2002, *Cell*, 110, 563-574, describe certain single stranded siRNA constructs, including certain 5'-phosphorylated single stranded siRNAs that mediate RNA interference in Hela cells. Harborth et al., 2003, *Antisense & Nucleic Acid Drug Development*, 13, 83-105, describe certain chemically and structurally modified siRNA molecules. Chiu and Rana, 2003, *RNA*, 9, 1034-1048, describe certain chemically and structurally modified siRNA molecules. Woolf et al., International PCT Publication Nos. WO 03/064626 and WO 03/064625 describe certain chemically modified dsRNA constructs. Hornung et al., 2005, *Nature Medicine*, 11, 263-270, describe the sequence-specific potent induction of IFN-alpha by short interfering RNA in plasmacytoid dendritic cells through TLR7. Judge et al., 2005, Nature Biotechnology, Published online: 20 Mar. 2005, describe the sequence-dependent stimulation of the mammalian innate immune response by synthetic siRNA. Yuki et al., International PCT Publication Nos. WO 05/049821 and WO 04/048566, describe certain methods for designing short interfering RNA sequences and certain short interfering RNA sequences with optimized activity. Saigo et al., US Patent Application Publication No. US20040539332, describe certain methods of designing oligo- or polynucleotide sequences, including short interfering RNA sequences, for achieving RNA interference. Tei et al., International PCT Publication No. WO 03/044188, describe certain methods for inhibiting expression of a target gene, which comprises transfecting a cell, tissue, or individual organism with a double-stranded polynucleotide comprising DNA and RNA having a substantially identical nucleotide sequence with at least a partial nucleotide sequence of the target gene.

McSwiggen et al., WO 03/070918 describe double stranded nucleic acid molecules, including short interfering nucleic acids, targeting RSV and conserved sequences within the RSV genome.

Bushman et al., US 2003/0203868 describe the inhibition of certain pathogens, including RSV, using certain RNA interference mediating ribonucleic acid molecules.

Vaillant et al., US 2004/0229828 describe certain antiviral single-stranded oligonucleotides targeting RSV.

Mohapatra et al., WO 05/056021 describe certain siRNA molecules targeting RSV.

Bitco et al., 2005, *Nature Medicine*, 11, 50-55, describes the use of certain nasally administered vector expressed siRNA constructs targeting RSV.

Zhang et al., 2005, *Nature Medicine*, 11, 56-62, describes the use of certain nasally administered vector expressed siRNA constructs targeting the Ni gene of RSV.

SUMMARY OF THE INVENTION

This invention relates to compounds, compositions, and methods useful for modulating the expression of genes, such as those genes associated with the development or maintenance of RSV infection and other disease states associated with RSV infection (e.g., respiratory distress, bronchiolitis and pneumonia), by RNA interference (RNAi) using short interfering nucleic acid (siNA) molecules. This invention also relates to compounds, compositions, and methods useful for modulating the expression and activity of other genes involved in pathways of RSV gene expression and/or activity by RNA interference (RNAi) using small nucleic acid molecules. In particular, the instant invention features small nucleic acid molecules, such as short interfering nucleic acid (siNA), short interfering RNA (siRNA), double-stranded RNA (dsRNA), micro-RNA (miRNA), and short hairpin RNA (shRNA) molecules and methods used to modulate the expression of RSV genes and/or other genes (e.g., cellular or host genes) involved in pathways of RSV gene expression and/or infection.

A siNA of the invention can be unmodified or chemically-modified. A siNA of the instant invention can be chemically synthesized, expressed from a vector or enzymatically synthesized. The instant invention also features various chemically-modified synthetic short interfering nucleic acid (siNA) molecules capable of modulating target gene expression or activity in cells by RNA interference (RNAi). The use of chemically-modified siNA improves various properties of native siNA molecules through increased resistance to nuclease degradation in vivo and/or through improved cellular uptake. Further, contrary to earlier published studies, siNA having multiple chemical modifications, including fully modified siNA, retains its RNAi activity. The siNA molecules of the instant invention provide useful reagents and methods for a variety of therapeutic, prophylactic, veterinary, diagnostic, target validation, genomic discovery, genetic engineering, and pharmacogenomic applications.

In one embodiment, the invention features one or more siNA molecules and methods that independently or in combination modulate the expression of gene(s) encoding RSV and/or cellular proteins associated with the maintenance or development of RSV infection, respiratory distress, bronchiolitis, and pneumonia, such as genes encoding sequences comprising those sequences referred to by GenBank Accession Nos. shown in Table I, referred to herein generally as RSV. The description below of the various aspects and embodiments of the invention is provided with reference to exemplary respiratory syncytial virus (RSV) genes (e.g., genes encoding RSV proteins such as nucleopretein (N), large (L) and phosphoproteins (P), matrix (M), fusion (F), glycoprotein (G), NS1 and 2 non-structural proteins, including small hydrophobic (SH) and M2 proteins), generally referred to herein as RSV. However, such reference is meant to be exemplary only and the various aspects and embodiments of the invention are also directed to other genes that express alternate RSV genes, such as mutant RSV genes, splice variants of RSV genes, and genes encoding different strains of RSV, as well as as cellular targets for RSV, such as those described herein and also referred to by GenBank Accession Nos. herein and in U.S. Ser. No. 10/923,536 and International Patent Application No. PCT/US03/05028, both incorporated by reference herein. The various aspects and embodiments are also directed to other genes involved in RSV pathways, including genes that encode cellular proteins involved in the maintenance and/or development of RSV infection, respiratory distress, bronchiolitis, and pneumonia, or other genes that express other proteins associated with RSV infection, such as cellular proteins that are utilized in the RSV life-cycle. Such additional genes can be analyzed for target sites using the methods described herein for RSV. Thus, the inhibition and the effects of such inhibition of the other genes can be performed as described herein. In other words, the term "RSV" as it is defined herein below and recited in the described embodiments, is meant to encompass genes associated with the development and/or maintenance of RSV infection, such as genes which encode RSV polypeptides, including polypeptides of different strains of RSV, mutant RSV genes, and splice variants of RSV genes, as well as cellular genes involved in RSV pathways of gene expression, replication, and/or RSV activity. Also, the term "RSV" as it is defined herein below and recited in the described embodiments, is meant to encompass RSV viral gene products and cellular gene products involved in RSV infection, such as those described herein. Thus, each of the embodiments described herein with reference to the term "RSV" are applicable to all of the virus, cellular and viral protein, peptide, polypeptide, and/or polynucleotide molecules covered by the term "RSV", as that term is defined herein. Comprehensively, such gene targets are also referred to herein generally as "target" sequences.

In one embodiment, the invention features a composition comprising two or more different siNA molecules of the invention (e.g., siNA, duplex forming siNA, or multifunctional siNA or any combination thereof) targeting different polynucleotide targets, such as different regions of RSV RNA (e.g., two different target sites herein or any combination of RSV proteins such as nucleopretein (N), large (L) and phosphoproteins (P), matrix (M), fusion (F), glycoprotein (G), NS1 and 2 non-structural proteins, including small hydrophobic (SH) and M2 protein targets), different viral strains (e.g., RSV strains), or HIV and RSV, RSV and HCV etc.), or different viral and cellular targets (e.g., a RSV target and a cellular target as described herein). Such pools of siNA molecules can prevent or overcome viral resistance or otherwise provide increased therapeutic effect.

In one embodiment, the invention features a pool of two or more different siNA molecules of the invention (e.g., siNA, duplex forming siNA, or multifunctional siNA or any combination thereof) targeting different polynucleotide targets, such as different regions of RSV RNA (e.g., two different target sites herein or any combination of RSV proteins such as nucleopretein (N), large (L) and phosphoproteins (P), matrix (M), fusion (F), glycoprotein (G), NS1 and 2 non-structural proteins, including small hydrophobic (SH) and M2 protein targets), different viral strains (e.g., RSV strains), or different viruses (e.g., HIV and RSV, RSV and HCV etc.), or different viral and cellular targets (e.g., a RSV target and a cellular target), wherein the pool comprises siNA molecules targeting about 2, 3, 4, 5, 6, 7, 8, 9, 10 or more different RSV targets.

In one embodiment, a siNA molecule of the invention targets the RSV negative strand RNA or has RNAi specificity for the RSV negative strand RNA.

In one embodiment, the invention features one or more siNA molecules and methods that independently or in combination modulate the expression of genes representing cellular targets for RSV infection (see for example Ghildyal et al, 2005, J Gen Virol, 86:1879-84), such as cellular receptors, cell surface molecules, cellular enzymes, cellular transcription factors, and/or cytokines, second messengers, and cellular accessory molecules including, but not limited to, ICAM-1 (e.g., Genbank Accession Number NM_000201), RhoA (see for example Budge et al., 2004, Journal of Antimicrobial Chemotherapy, 54(2):299-302, e.g., Genbank Accession No. NM_044472); FAS (e.g., Genbank Accession No. NM_000043) or FAS ligand (e.g., Genbank Accession No. NM_000639); interferon regulatory factors (IRFs; e.g., Genbank Accession No. AF082503.1); cellular PKR protein kinase (e.g., Genbank Accession No. XM_002661.7); human eukaryotic initiation factors 2B (eIF2Bgamma; e.g., Genbank Accession No. AF256223, and/or eIF2gamma; e.g., Genbank Accession No. NM_006874.1); human DEAD Box protein (DDX3; e.g., Genbank Accession No. XM_018021.2); and polypyrimidine tract-binding protein (e.g., Genbank Accession Nos. NM_031991.1 and XM_042972.3). Such cellular targets are also referred to herein generally as RSV targets, and specifically as "host target" or "host targets".

Due to the high sequence variability of the RSV genome, selection of siNA molecules for broad therapeutic applications likely involve the conserved regions of the RSV genome.

In one embodiment, the present invention relates to siNA molecules that target the conserved regions of the RSV genome. Examples of conserved regions of the RSV genome include, but are not limited to, the attachment (G) glycoprotein (see for example Trento et al., 2006, J. Virology, 80, 975-984) and polyadenylation/termination signal sequences (see for example Harmon et al., 2001, J. Virology, 75, 36-44). siNA molecules designed to target conserved regions of various RSV isolates enable efficient inhibition of RSV replication in diverse patient populations and ensure the effectiveness of the siNA molecules against RSV quasi species which evolve due to mutations in the non-conserved regions of the RSV genome. As described, a single siNA molecule can be targeted against all isolates of RSV by designing the siNA molecule to interact with conserved nucleotide sequences of RSV (e.g., sequences that are expected to be present in the RNA of various RSV isolates).

In one embodiment, the invention features a double stranded nucleic acid molecule, such as an siNA molecule, where one of the strands comprises nucleotide sequence having complementarity to a predetermined nucleotide sequence in a RSV target nucleic acid molecule, or a portion thereof. In one embodiment, the predetermined nucleotide sequence is a nucleotide RSV target sequence described herein. In another embodiment, the predetermined nucleotide sequence is a RSV target sequence as is known in the art.

In one embodiment, the invention features a double-stranded short interfering nucleic acid (siNA) molecule that down-regulates expression of a RSV target gene or that directs cleavage of a RSV target RNA, wherein said siNA molecule comprises about 15 to about 28 base pairs.

In one embodiment, the invention features a double-stranded short interfering nucleic acid (siNA) molecule that directs cleavage of a RSV target RNA, wherein said siNA molecule comprises about 15 to about 28 base pairs.

In one embodiment, the invention features a double stranded short interfering nucleic acid (siNA) molecule that directs cleavage of a RSV target RNA via RNA interference (RNAi), wherein the double stranded siNA molecule comprises a first and a second strand, each strand of the siNA molecule is about 18 to about 28 nucleotides in length, the first strand of the siNA molecule comprises nucleotide sequence having sufficient complementarity to the RSV target RNA for the siNA molecule to direct cleavage of the RSV target RNA via RNA interference, and the second strand of said siNA molecule comprises nucleotide sequence that is complementary to the first strand.

In one embodiment, the invention features a double stranded short interfering nucleic acid (siNA) molecule that directs cleavage of a RSV target RNA via RNA interference (RNAi), wherein the double stranded siNA molecule comprises a first and a second strand, each strand of the siNA molecule is about 18 to about 23 nucleotides in length, the first strand of the siNA molecule comprises nucleotide sequence having sufficient complementarity to the RSV target RNA for the siNA molecule to direct cleavage of the RSV target RNA via RNA interference, and the second strand of said siNA molecule comprises nucleotide sequence that is complementary to the first strand.

In one embodiment, the invention features a chemically synthesized double stranded short interfering nucleic acid (siNA) molecule that directs cleavage of a RSV target RNA via RNA interference (RNAi), wherein each strand of the siNA molecule is about 18 to about 28 nucleotides in length; and one strand of the siNA molecule comprises nucleotide sequence having sufficient complementarity to the RSV target RNA for the siNA molecule to direct cleavage of the RSV target RNA via RNA interference.

In one embodiment, the invention features a chemically synthesized double stranded short interfering nucleic acid (siNA) molecule that directs cleavage of a RSV target RNA via RNA interference (RNAi), wherein each strand of the siNA molecule is about 18 to about 23 nucleotides in length; and one strand of the siNA molecule comprises nucleotide sequence having sufficient complementarity to the RSV target RNA for the siNA molecule to direct cleavage of the RSV target RNA via RNA interference.

In one embodiment, the invention features a siNA molecule that down-regulates expression of a RSV target gene or that directs cleavage of a RSV target RNA, for example, wherein the RSV target gene or RNA comprises protein encoding sequence. In one embodiment, the invention features a siNA molecule that down-regulates expression of a RSV target gene or that directs cleavage of a RSV target RNA, for example, wherein the RSV target gene or RNA comprises non-coding sequence or regulatory elements involved in RSV target gene expression (e.g., non-coding RNA).

In one embodiment, a siNA of the invention is used to inhibit the expression of RSV target genes or a RSV target gene family (e.g., different RSV strains, such as subgroup A and B strains), wherein the genes or gene family sequences share sequence homology. Such homologous sequences can be identified as is known in the art, for example using sequence alignments. siNA molecules can be designed to target such homologous sequences, for example using perfectly complementary sequences or by incorporating non-canonical base pairs, for example mismatches and/or wobble base pairs, that can provide additional RSV target sequences. In instances where mismatches are identified, non-canonical base pairs (for example, mismatches and/or wobble bases) can be used to generate siNA molecules that RSV target more than one gene sequence. In a non-limiting example, non-canonical base pairs such as UU and CC base pairs are used to generate siNA molecules that are capable of RSV targeting sequences for differing polynucleotide RSV targets that share sequence homology. As such, one advantage of using siNAs of the invention is that a single siNA can be designed to include nucleic acid sequence that is complementary to the nucleotide sequence that is conserved between the homologous genes. In this approach, a single siNA can be used to inhibit expression of more than one gene instead of using more than one siNA molecule to target the different genes.

In one embodiment, the invention features a siNA molecule having RNAi activity against RSV target RNA (e.g., coding or non-coding RNA), wherein the siNA molecule comprises a sequence complementary to any RNA sequence, such as those sequences having GenBank Accession Nos. shown in Table I herein, or is U.S. Ser. No. 10/923,536 and PCT/US03/05028, both incorporated by reference herein. In another embodiment, the invention features a siNA molecule having RNAi activity against RSV target RNA, wherein the siNA molecule comprises a sequence complementary to an RNA having variant encoding sequence, for example other mutant genes known in the art to be associated with the maintenance and/or development of diseases, traits, disorders, and/or conditions described herein or otherwise known in the art. Chemical modifications as shown in Table IV or otherwise described herein can be applied to any siNA construct of the invention. In another embodiment, a siNA molecule of the invention includes a nucleotide sequence that can interact with nucleotide sequence of a RSV target gene and thereby mediate silencing of RSV target gene expression, for example, wherein the siNA mediates regulation of RSV target gene expression by cellular processes that modulate the chromatin structure or methylation patterns of the RSV target gene and prevent transcription of the RSV target gene.

In one embodiment, siNA molecules of the invention are used to down regulate or inhibit the expression of proteins arising from haplotype polymorphisms that are associated with a trait, disease or condition in a subject or organism. Analysis of genes, or protein or RNA levels can be used to identify subjects with such polymorphisms or those subjects who are at risk of developing traits, conditions, or diseases described herein. These subjects are amenable to treatment, for example, treatment with siNA molecules of the invention and any other composition useful in treating diseases related to target gene expression. As such, analysis of protein or RNA levels can be used to determine treatment type and the course of therapy in treating a subject. Monitoring of protein or RNA levels can be used to predict treatment outcome and to determine the efficacy of compounds and compositions that modulate the level and/or activity of certain proteins associated with a trait, disorder, condition, or disease.

In one embodiment of the invention a siNA molecule comprises an antisense strand comprising a nucleotide sequence that is complementary to a nucleotide sequence or a portion thereof encoding a RSV target protein. The siNA further comprises a sense strand, wherein said sense strand comprises a nucleotide sequence of a RSV target gene or a portion thereof.

In another embodiment, a siNA molecule comprises an antisense region comprising a nucleotide sequence that is complementary to a nucleotide sequence encoding a RSV target protein or a portion thereof. The siNA molecule further comprises a sense region, wherein said sense region comprises a nucleotide sequence of a RSV target gene or a portion thereof.

In another embodiment, the invention features a siNA molecule comprising nucleotide sequence, for example, nucleotide sequence in the antisense region of the siNA molecule that is complementary to a nucleotide sequence or portion of sequence of a RSV target gene. In another embodiment, the invention features a siNA molecule comprising a region, for example, the antisense region of the siNA construct, complementary to a sequence comprising a RSV target gene sequence or a portion thereof.

In one embodiment, the sense region or sense strand of a siNA molecule of the invention is complementary to that portion of the antisense region or antisense strand of the siNA molecule that is complementary to a RSV target polynucleotide sequence.

In yet another embodiment, the invention features a siNA molecule comprising a sequence, for example, the antisense sequence of the siNA construct, complementary to a sequence or portion of sequence comprising sequence represented by GenBank Accession Nos. shown in Table I and in U.S. Ser. No. 10/923,536 and PCT/US03/05028, both incorporated by reference herein. Chemical modifications in Tables III and IV and described herein can be applied to any siNA construct of the invention.

In one embodiment of the invention a siNA molecule comprises an antisense strand having about 15 to about 30 (e.g., about 15, 16, 17, 18, 19, 20, 21, 22, 23, 24, 25, 26, 27, 28, 29, or 30) nucleotides, wherein the antisense strand is complementary to a RSV target RNA sequence or a portion thereof, and wherein said siNA further comprises a sense strand having about 15 to about 30 (e.g., about 15, 16, 17, 18, 19, 20, 21, 22, 23, 24, 25, 26, 27, 28, 29, or 30) nucleotides, and wherein said sense strand and said antisense strand are distinct nucleotide sequences where at least about 15 nucleotides in each strand are complementary to the other strand.

In one embodiment, a siNA molecule of the invention (e.g., a double stranded nucleic acid molecule) comprises an antisense (guide) strand having about 15 to about 30 (e.g., about 15, 16, 17, 18, 19, 20, 21, 22, 23, 24, 25, 26, 27, 28, 29, or 30) nucleotides that are complementary to a RNA sequence of RSV or a portion thereof. In one embodiment, at least 15 nucleotides (e.g., 15, 16, 17, 18, 19, 20, 21, 22, 23, 24, 25, 26, 27, 28, 29, or 30 nucleotides) of a RSV RNA sequence are complementary to the antisense (guide) strand of a siNA molecule of the invention.

In one embodiment, a siNA molecule of the invention (e.g., a double stranded nucleic acid molecule) comprises a sense (passenger) strand having about 15 to about 30 (e.g., about 15, 16, 17, 18, 19, 20, 21, 22, 23, 24, 25, 26, 27, 28, 29, or 30) nucleotides that comprise sequence of a RSV RNA or a portion thereof. In one embodiment, at least 15 nucleotides (e.g., about 15, 16, 17, 18, 19, 20, 21, 22, 23, 24, 25, 26, 27, 28, 29, or 30) nucleotides of a RSV RNA sequence comprise the sense (passenger) strand of a siNA molecule of the invention.

In another embodiment of the invention a siNA molecule of the invention comprises an antisense region having about 15 to about 30 (e.g., about 15, 16, 17, 18, 19, 20, 21, 22, 23, 24, 25, 26, 27, 28, 29, or 30) nucleotides, wherein the antisense region is complementary to a RSV target DNA sequence, and wherein said siNA further comprises a sense region having about 15 to about 30 (e.g., about 15, 16, 17, 18, 19, 20, 21, 22, 23, 24, 25, 26, 27, 28, 29, or 30) nucleotides, wherein said sense region and said antisense region are comprised in a linear molecule where the sense region comprises at least about 15 nucleotides that are complementary to the antisense region.

In one embodiment, a siNA molecule of the invention has RNAi activity that modulates expression of RNA encoded by a RSV gene. Because RSV genes can share some degree of sequence homology with each other, siNA molecules can be designed to target a class of RSV genes (e.g., a class of different RSV strains or subtypes) or alternately specific RSV genes (e.g., escape mutants, resistant strains, or other polymorphic variants) by selecting sequences that are either shared amongst different RSV targets or alternatively that are unique for a specific RSV target (e.g., unique for any of the NS1, NS2, N, P, M, SH, G, F, M2, or L genes/proteins). Therefore, in one embodiment, the siNA molecule can be designed to target conserved regions of RSV RNA sequences having homology among several RSV gene variants so as to target a class of RSV genes with one siNA molecule. Accordingly, in one embodiment, the siNA molecule of the invention modulates the expression of one or more RSV stains in a subject or organism. In another embodiment, the siNA molecule can be designed to target a sequence that is unique to a specific RSV RNA sequence (e.g., a single RSV strain or RSV single nucleotide polymorphism (SNP)) due to the high degree of specificity that the siNA molecule requires to mediate RNAi activity.

In one embodiment, nucleic acid molecules of the invention that act as mediators of the RNA interference gene silencing response are double-stranded nucleic acid molecules. In another embodiment, the siNA molecules of the invention consist of duplex nucleic acid molecules containing about 15 to about 30 base pairs between oligonucleotides comprising about 15 to about 30 (e.g., about 15, 16, 17, 18, 19, 20, 21, 22, 23, 24, 25, 26, 27, 28, 29, or 30) nucleotides. In yet another embodiment, siNA molecules of the invention comprise duplex nucleic acid molecules with overhanging ends of about 1 to about 3 (e.g., about 1, 2, or 3) nucleotides, for example, about 21-nucleotide duplexes with about 19 base pairs and 3'-terminal mononucleotide, dinucleotide, or trinucleotide overhangs. In yet another embodiment, siNA molecules of the invention comprise duplex nucleic acid molecules with blunt ends, where both ends are blunt, or alternatively, where one of the ends is blunt.

In one embodiment, a double stranded nucleic acid (e.g., siNA) molecule comprises nucleotide or non-nucleotide overhangs. By "overhang" is meant a terminal portion of the nucleotide sequence that is not base paired between the two strands of a double stranded nucleic acid molecule (see for example FIG. 6). In one embodiment, a double stranded nucleic acid molecule of the invention can comprise nucleotide or non-nucleotide overhangs at the 3'-end of one or both strands of the double stranded nucleic acid molecule. For example, a double stranded nucleic acid molecule of the invention can comprise a nucleotide or non-nucleotide overhang at the 3'-end of the guide strand or antisense strand/region, the 3'-end of the passenger strand or sense strand/region, or both the guide strand or antisense strand/region and the passenger strand or sense strand/region of the double stranded nucleic acid molecule. In another embodiment, the nucleotide overhang portion of a double stranded nucleic acid (siNA) molecule of the invention comprises 2'-O-methyl, 2'-deoxy, 2'-deoxy-2'-fluoro, 2'-deoxy-2'-fluoroarabino (FANA), 4'-thio, 2'-O-trifluoromethyl, 2'-O-ethyl-trifluoromethoxy, 2'-O-difluoromethoxy-ethoxy, universal base, acyclic, or 5-C-methyl nucleotides. In another embodiment, the non-nucleotide overhang portion of a double stranded nucleic acid (siNA) molecule of the invention comprises glyceryl, abasic, or inverted deoxy abasic non-nucleotides.

In one embodiment, the nucleotides comprising the overhang portions of a double stranded nucleic acid (e.g., siNA) molecule of the invention correspond to the nucleotides comprising the RSV target polynucleotide sequence of the siNA molecule. Accordingly, in such embodiments, the nucleotides comprising the overhang portion of a siNA molecule of the invention comprise sequence based on the RSV target polynucleotide sequence in which nucleotides comprising the overhang portion of the guide strand or antisense strand/region of a siNA molecule of the invention can be complementary to nucleotides in the RSV target polynucleotide sequence and nucleotides comprising the overhang portion of the passenger strand or sense strand/region of a siNA molecule of the invention can comprise the nucleotides in the RSV target polynucleotide sequence. Such nucleotide overhangs comprise sequence that would result from Dicer processing of a native dsRNA into siRNA.

In one embodiment, the nucleotides comprising the overhang portion of a double stranded nucleic acid (e.g., siNA) molecule of the invention are complementary to the RSV target polynucleotide sequence and are optionally chemically modified as described herein. As such, in one embodiment, the nucleotides comprising the overhang portion of the guide strand or antisense strand/region of a siNA molecule of the invention can be complementary to nucleotides in the RSV target polynucleotide sequence, i.e. those nucleotide positions in the RSV target polynucleotide sequence that are complementary to the nucleotide positions of the overhang nucleotides in the guide strand or antisense strand/region of a siNA molecule.

In another embodiment, the nucleotides comprising the overhang portion of the passenger strand or sense strand/region of a siNA molecule of the invention can comprise the nucleotides in the RSV target polynucleotide sequence, i.e. those nucleotide positions in the RSV target polynucleotide sequence that correspond to same the nucleotide positions of the overhang nucleotides in the passenger strand or sense strand/region of a siNA molecule. In one embodiment, the overhang comprises a two nucleotide (e.g., 3'-GA; 3'-GU; 3'-GG; 3'-GC; 3'-CA; 3'-CU; 3'-CG; 3'CC; 3'-UA; 3'-UU; 3'-UG; 3'UC; 3'-AA; 3'-AU; 3'-AG; 3'-AC; 3'-TA; 3'-TU; 3'-TG; 3'-TC; 3'-AT; 3'-UT; 3'-GT; 3'-CT) overhang that is complementary to a portion of the RSV target polynucleotide sequence. In one embodiment, the overhang comprises a two nucleotide (e.g., 3'-GA; 3'-GU; 3'-GG; 3'GC; 3'-CA; 3'-CU; 3'-CG; 3'CC; 3'-UA; 3'-UU; 3'-UG; 3'UC; 3'-AA; 3'-AU; 3'-AG; 3'-AC; 3'-TA; 3'-TU; 3'-TG; 3'-TC; 3'-AT; 3'-UT; 3'-GT; 3'-CT) overhang that is not complementary to a portion of the RSV target polynucleotide sequence. In another embodiment, the overhang nucleotides of a siNA molecule of the invention are 2'-O-methyl nucleotides, 2'-deoxy-2'-fluoroarabino, and/or 2'-deoxy-2'-fluoro nucleotides. In another embodiment, the overhang nucleotides of a siNA molecule of the invention are 2'-O-methyl nucleotides in the event the overhang nucleotides are purine nucleotides and/or 2'-deoxy-2'-fluoro nucleotides or 2'-deoxy-2'-fluoroarabino nucleotides in the event the overhang nucleotides are pyrimidines nucleotides.

In another embodiment, the purine nucleotide (when present) in an overhang of siNA molecule of the invention is 2'-O-methyl nucleotides. In another embodiment, the pyrimidine nucleotide (when present) in an overhang of siNA molecule of the invention are 2'-deoxy-2'-fluoro or 2'-deoxy-2'-fluoroarabino nucleotides.

In one embodiment, the nucleotides comprising the overhang portion of a double stranded nucleic acid (e.g., siNA) molecule of the invention are not complementary to the RSV target polynucleotide sequence and are optionally chemically modified as described herein. In one embodiment, the overhang comprises a 3'-UU overhang that is not complementary to a portion of the RSV target polynucleotide sequence. In another embodiment, the nucleotides comprising the overhanging portion of a siNA molecule of the invention are 2'-O-methyl nucleotides, 2'-deoxy-2'-fluoroarabino and/or 2'-deoxy-2'-fluoro nucleotides.

In one embodiment, the double stranded nucleic molecule (e.g. siNA) of the invention comprises a two or three nucleotide overhang, wherein the nucleotides in the overhang are same or different. In one embodiment, the double stranded nucleic molecule (e.g. siNA) of the invention comprises a two or three nucleotide overhang, wherein the nucleotides ain the overhang are the same or different and wherein one or more nucleotides in the overhang are chemically modified at the base, sugar and/or phosphate backbone.

In one embodiment, the invention features one or more chemically-modified siNA constructs having specificity for RSV target nucleic acid molecules, such as DNA, or RNA encoding a protein or non-coding RNA associated with the expression of RSV target genes.

In one embodiment, the invention features a RNA based siNA molecule (e.g., a siNA comprising 2'-OH nucleotides) having specificity for nucleic acid molecules that includes one or more chemical modifications described herein. Non-limiting examples of such chemical modifications include without limitation phosphorothioate internucleotide linkages, 2'-deoxyribonucleotides, 2'-O-methyl ribonucleotides, 2'-deoxy-2'-fluoro ribonucleotides, 4'-thio ribonucleotides, 2'-O-trifluoromethyl nucleotides, 2'-O-ethyl-trifluoromethoxy nucleotides, 2'-O-difluoromethoxy-ethoxy nucleotides (see for example U.S. Ser. No. 10/981,966 filed Nov. 5, 2004, incorporated by reference herein), "universal base" nucleotides, "acyclic" nucleotides, 5-C-methyl nucleotides, 2'-deoxy-2'-fluoroarabino (FANA, see for example Dowler et al., 2006, Nucleic Acids Research, 34, 1669-1675) and terminal glyceryl and/or inverted deoxy abasic residue incorporation. These chemical modifications, when used in various siNA constructs, (e.g., RNA based siNA constructs), are shown to preserve RNAi activity in cells while at the same time, dramatically increasing the serum stability of these compounds.

In one embodiment, a siNA molecule of the invention comprises modified nucleotides while maintaining the ability to mediate RNAi. The modified nucleotides can be used to improve in vitro or in vivo characteristics such as stability, activity, and/or bioavailability. For example, a siNA molecule of the invention can comprise modified nucleotides as a percentage of the total number of nucleotides present in the siNA molecule. As such, a siNA molecule of the invention can generally comprise about 5% to about 100% modified nucleotides (e.g., about 5%, 10%, 15%, 20%, 25%, 30%, 35%, 40%, 45%, 50%, 55%, 60%, 65%, 70%, 75%, 80%, 85%, 90%, 95% or 100% modified nucleotides). For example, in one embodiment, between about 5% to about 100% (e.g., about 5%, 10%, 15%, 20%, 25%, 30%, 35%, 40%, 45%, 50%, 55%, 60%, 65%, 70%, 75%, 80%, 85%, 90%, 95% or 100% modified nucleotides) of the nucleotide positions in a siNA molecule of the invention comprise a nucleic acid sugar modification, such as a 2'-sugar modification, e.g., 2'-O-methyl nucleotides, 2'-deoxy-2'-fluoro nucleotides, 2'-deoxy-2'-fluoroarabino, 2'-O-methoxyethyl nucleotides, 2'-O-trifluoromethyl nucleotides, 2'-O-ethyl-trifluoromethoxy nucleotides, 2'-O-difluoromethoxy-ethoxy nucleotides, or 2'-deoxy nucleotides. In another embodiment, between about 5% to about 100% (e.g., about 5%, 10%, 15%, 20%, 25%, 30%, 35%, 40%, 45%, 50%, 55%, 60%, 65%, 70%, 75%, 80%, 85%, 90%, 95% or 100% modified nucleotides) of the nucleotide positions in a siNA molecule of the invention comprise a nucleic acid base modification, such as inosine, purine, pyridin-4-one, pyridin-2-one, phenyl, pseudouracil, 2,4,6-trimethoxy benzene, 3-methyl uracil, dihydrouridine, naphthyl, aminophenyl, 5-alkylcytidines (e.g., 5-methylcytidine), 5-alkyluridines (e.g., ribothymidine), 5-halouridine (e.g., 5-bromouridine) or 6-azapyrimidines or 6-alkylpyrimidines (e.g. 6-methyluridine), or propyne modifications. In another embodiment, between about 5% to about 100% (e.g., about 5%, 10%, 15%, 20%, 25%, 30%, 35%, 40%, 45%, 50%, 55%, 60%, 65%, 70%, 75%, 80%, 85%, 90%, 95% or 100% modified nucleotides) of the nucleotide positions in a siNA molecule of the invention comprise a nucleic acid backbone modification, such as a backbone modification having Formula I herein. In another embodiment, between about 5% to about 100% (e.g., about 5%, 10%, 15%, 20%, 25%, 30%, 35%, 40%, 45%, 50%, 55%, 60%, 65%, 70%, 75%, 80%, 85%, 90%, 95% or 100% modified nucleotides) of the nucleotide positions in a siNA molecule of the invention comprise a nucleic acid sugar, base, or backbone modification or any combination thereof (e.g., any combination of nucleic acid sugar, base, backbone or non-nucleotide modifications herein). The actual percentage of modified nucleotides present in a given siNA molecule will depend on the total number of nucleotides present in the siNA. If the siNA molecule is single stranded, the percent modification can be based upon the total number of nucleotides present in the single stranded siNA molecules. Likewise, if the siNA molecule is double stranded, the percent modification can be based upon the total number of nucleotides present in the sense strand, antisense strand, or both the sense and antisense strands.

A siNA molecule of the invention can comprise modified nucleotides at various locations within the siNA molecule. In one embodiment, a double stranded siNA molecule of the invention comprises modified nucleotides at internal base paired positions within the siNA duplex. For example, internal positions can comprise positions from about 3 to about 19 nucleotides from the 5'-end of either sense or antisense strand or region of a 21 nucleotide siNA duplex having 19 base pairs and two nucleotide 3'-overhangs. In another embodiment, a double stranded siNA molecule of the invention comprises modified nucleotides at non-base paired or overhang regions of the siNA molecule. By "non-base paired" is meant, the nucleotides are not base paired between the sense strand or sense region and the antisense strand or antisense region or the siNA molecule. The overhang nucleotides can be complementary or base paired to a corresponding RSV target polynucleotide sequence (see for example FIG. 6C). For example, overhang positions can comprise positions from about 20 to about 21 nucleotides from the 5'-end of either sense or antisense strand or region of a 21 nucleotide siNA duplex having 19 base pairs and two nucleotide 3'-overhangs. In another embodiment, a double stranded siNA molecule of the invention comprises modified nucleotides at terminal positions of the siNA molecule. For example, such terminal regions include the 3'-position, 5'-position, for both 3' and 5'-positions of the sense and/or antisense strand or region of the siNA molecule. In another embodiment, a double stranded siNA molecule of the invention comprises modified nucleotides at base-paired or internal positions, non-base paired or overhang regions, and/or terminal regions, or any combination thereof.

One aspect of the invention features a double-stranded short interfering nucleic acid (siNA) molecule that down-regulates expression of a RSV target gene or that directs cleavage of a RSV target RNA. In one embodiment, the double stranded siNA molecule comprises one or more chemical modifications and each strand of the double-stranded siNA is about 21 nucleotides long. In one embodiment, the double-stranded siNA molecule does not contain any ribonucleotides. In another embodiment, the double-stranded siNA molecule comprises one or more ribonucleotides. In one embodiment, each strand of the double-stranded siNA molecule independently comprises about 15 to about 30 (e.g., about 15, 16, 17, 18, 19, 20, 21, 22, 23, 24, 25, 26, 27, 28, 29, or 30) nucleotides, wherein each strand comprises about 15 to about 30 (e.g., about 15, 16, 17, 18, 19, 20, 21, 22, 23, 24, 25, 26, 27, 28, 29, or 30) nucleotides that are complementary to the nucleotides of the other strand. In one embodiment, one of the strands of the double-stranded siNA molecule comprises a nucleotide sequence that is complementary to a nucleotide sequence or a portion thereof of the RSV target gene, and the second strand of the double-stranded siNA molecule comprises a nucleotide sequence substantially similar to the nucleotide sequence of the RSV target gene or a portion thereof.

In another embodiment, the invention features a double-stranded short interfering nucleic acid (siNA) molecule that down-regulates expression of a RSV target gene or that directs cleavage of a RSV target RNA, comprising an antisense region, wherein the antisense region comprises a nucleotide sequence that is complementary to a nucleotide sequence of the RSV target gene or a portion thereof, and a sense region, wherein the sense region comprises a nucleotide sequence substantially similar to the nucleotide sequence of the RSV target gene or a portion thereof. In one embodiment, the antisense region and the sense region independently comprise about 15 to about 30 (e.g. about 15, 16, 17, 18, 19, 20, 21, 22, 23, 24, 25, 26, 27, 28, 29, or 30) nucleotides, wherein the antisense region comprises about 15 to about 30 (e.g. about 15, 16, 17, 18, 19, 20, 21, 22, 23, 24, 25, 26, 27, 28, 29, or 30) nucleotides that are complementary to nucleotides of the sense region.

In another embodiment, the invention features a double-stranded short interfering nucleic acid (siNA) molecule that down-regulates expression of a RSV target gene or that directs cleavage of a RSV target RNA, comprising a sense region and an antisense region, wherein the antisense region comprises a nucleotide sequence that is complementary to a nucleotide sequence of RNA encoded by the RSV target gene or a portion thereof and the sense region comprises a nucleotide sequence that is complementary to the antisense region.

In one embodiment, a siNA molecule of the invention comprises blunt ends, i.e., ends that do not include any overhanging nucleotides. For example, a siNA molecule-comprising modifications described herein (e.g., comprising nucleotides having Formulae I-VII or siNA constructs comprising "Stab 00"-"Stab 34" or "Stab 3F"-"Stab 34F" (Table IV) or any combination thereof (see Table IV)) and/or any length described herein can comprise blunt ends or ends with no overhanging nucleotides.

In one embodiment, any siNA molecule of the invention can comprise one or more blunt ends, i.e. where a blunt end does not have any overhanging nucleotides. In one embodiment, the blunt ended siNA molecule has a number of base pairs equal to the number of nucleotides present in each strand of the siNA molecule. In another embodiment, the siNA molecule comprises one blunt end, for example wherein the 5'-end of the antisense strand and the 3'-end of the sense strand do not have any overhanging nucleotides. In another example, the siNA molecule comprises one blunt end, for example wherein the 3'-end of the antisense strand and the 5'-end of the sense strand do not have any overhanging nucleotides. In another example, a siNA molecule comprises two blunt ends, for example wherein the 3'-end of the antisense strand and the 5'-end of the sense strand as well as the 5'-end of the antisense strand and 3'-end of the sense strand do not have any overhanging nucleotides. A blunt ended siNA molecule can comprise, for example, from about 15 to about 30 nucleotides (e.g., about 15, 16, 17, 18, 19, 20, 21, 22, 23, 24, 25, 26, 27, 28, 29, or 30 nucleotides). Other nucleotides present in a blunt ended siNA molecule can comprise, for example, mismatches, bulges, loops, or wobble base pairs to modulate the activity of the siNA molecule to mediate RNA interference.

By "blunt ends" is meant symmetric termini or termini of a double stranded siNA molecule having no overhanging nucleotides. The two strands of a double stranded siNA molecule align with each other without over-hanging nucleotides at the termini. For example, a blunt ended siNA construct comprises terminal nucleotides that are complementary between the sense and antisense regions of the siNA molecule.

In one embodiment, the invention features a double-stranded short interfering nucleic acid (siNA) molecule that down-regulates expression of a RSV target gene or that directs cleavage of a RSV target RNA, wherein the siNA molecule is assembled from two separate oligonucleotide fragments wherein one fragment comprises the sense region and the second fragment comprises the antisense region of the siNA molecule. The sense region can be connected to the antisense region via a linker molecule, such as a polynucleotide linker or a non-nucleotide linker.

In one embodiment, a double stranded nucleic acid molecule (e.g., siNA) molecule of the invention comprises ribonucleotides at positions that maintain or enhance RNAi activity. In one embodiment, ribonucleotides are present in the sense strand or sense region of the siNA molecule, which can provide for RNAi activity by allowing cleavage of the sense strand or sense region by an enzyme within the RISC (e.g., ribonucleotides present at the position of passenger strand, sense strand or sense region cleavage, such as position 9 of the passenger strand of a 19 base-pair duplex is cleaved in the RISC by AGO2 enzyme, see for example Matranga et al., 2005, *Cell*, 123:1-114 and Rand et al., 2005, *Cell*, 123:621-629). In another embodiment, one or more (for example 1, 2, 3, 4 or 5) nucleotides at the 5'-end of the guide strand or guide region (also known as antisense strand or antisense region) of the siNA molecule are ribonucleotides.

In one embodiment, a double stranded nucleic acid molecule (e.g., siNA) molecule of the invention comprises one or more ribonucleotides at positions within the passenger strand or passenger region (also known as the sense strand or sense region) that allows cleavage of the passenger strand or passenger region by an enzyme in the RISC, (e.g., ribonucleotides present at the position of passenger strand such as position 9 of the passenger strand of a 19 base-pair duplex is cleaved in the RISC by AGO2 enzyme, see for example Matranga et al., 2005, *Cell*, 123:1-114 and Rand et al., 2005, *Cell*, 123:621-629).

In one embodiment, a siNA molecule of the invention contains at least 2, 3, 4, 5, or more chemical modifications that can be the same of different. In one embodiment, a siNA molecule of the invention contains at least 2, 3, 4, 5, or more different chemical modifications.

In one embodiment, a siNA molecule of the invention is a double-stranded short interfering nucleic acid (siNA), wherein the double stranded nucleic acid molecule comprises about 15 to about 30 (e.g. about 15, 16, 17, 18, 19, 20, 21, 22, 23, 24, 25, 26, 27, 28, 29, or 30) base pairs, and wherein one or more (e.g., at least 1, 2, 3, 4, 5, 6, 7, 8, 9, 10, 11, 12, 13, 14, 15, 16, 17, 18, 19, 20, 21, 22, 23, 24, 25, 26, 27, 28, 29, or 30) of the nucleotide positions in each strand of the siNA molecule comprises a chemical modification. In another embodiment, the siNA contains at least 2, 3, 4, 5, or more different chemical modifications.

In one embodiment, the invention features double-stranded short interfering nucleic acid (siNA) molecule that down-regulates expression of a RSV target gene or that directs cleavage of a RSV target RNA, wherein the siNA molecule comprises about 15 to about 30 (e.g. about 15, 16, 17, 18, 19, 20, 21, 22, 23, 24, 25, 26, 27, 28, 29, or 30) base pairs, and wherein each strand of the siNA molecule comprises one or more chemical modifications. In one embodiment, each strand of the double stranded siNA molecule comprises at least two (e.g., 2, 3, 4, 5, or more) different chemical modifications, e.g., different nucleotide sugar, base, or backbone modifications. In another embodiment, one of the strands of the double-stranded siNA molecule comprises a nucleotide sequence that is complementary to a nucleotide sequence of a RSV target gene or a portion thereof, and the second strand of the double-stranded siNA molecule comprises a nucleotide sequence substantially similar to the nucleotide sequence or a portion thereof of the RSV target gene. In another embodiment, one of the strands of the double-stranded siNA molecule comprises a nucleotide sequence that is complementary to a nucleotide sequence of a RSV target gene or portion thereof, and the second strand of the double-stranded siNA molecule comprises a nucleotide sequence substantially similar to the nucleotide sequence or portion thereof of the RSV target gene. In another embodiment, each strand of the siNA molecule comprises about 15 to about 30 (e.g. about 15, 16, 17, 18, 19, 20, 21, 22, 23, 24, 25, 26, 27, 28, 29, or 30) nucleotides, and each strand comprises at least about 15 to about 30 (e.g. about 15, 16, 17, 18, 19, 20, 21, 22, 23, 24, 25, 26, 27, 28, 29, or 30) nucleotides that are complementary to the nucleotides of the other strand. The RSV target gene can comprise, for example, sequences referred to herein or incorporated herein by reference. The RSV gene can comprise, for example, sequences referred to in Table I.

In one embodiment, each strand of a double stranded siNA molecule of the invention comprises a different pattern of chemical modifications, such as any "Stab 00"-"Stab 34" or "Stab 3F"-"Stab 34F" (Table IV) modification patterns herein or any combination thereof (see Table IV). Non-limiting examples of sense and antisense strands of such siNA molecules having various modification patterns are shown in Table III and FIGS. 4 and 5.

In one embodiment, a siNA molecule of the invention comprises no ribonucleotides. In another embodiment, a siNA molecule of the invention comprises ribonucleotides.

In one embodiment, a siNA molecule of the invention comprises an antisense region comprising a nucleotide sequence that is complementary to a nucleotide sequence of a RSV target gene or a portion thereof, and the siNA further comprises a sense region comprising a nucleotide sequence substantially similar to the nucleotide sequence of the RSV target gene or a portion thereof. In another embodiment, the antisense region and the sense region each comprise about 15 to about 30 (e.g. about 15, 16, 17, 18, 19, 20, 21, 22, 23, 24, 25, 26, 27, 28, 29, or 30) nucleotides and the antisense region comprises at least about 15 to about 30 (e.g. about 15, 16, 17, 18, 19, 20, 21, 22, 23, 24, 25, 26, 27, 28, 29, or 30) nucleotides that are complementary to nucleotides of the sense region. In one embodiment, each strand of the double stranded siNA molecule comprises at least two (e.g., 2, 3, 4, 5, or more) different chemical modifications, e.g., different nucleotide sugar, base, or backbone modifications. The RSV target gene can comprise, for example, sequences referred to herein or incorporated by reference herein. In another embodiment, the siNA is a double stranded nucleic acid molecule, where each of the two strands of the siNA molecule independently comprise about 15 to about 40 (e.g. about 15, 16, 17, 18, 19, 20, 21, 22, 23, 24, 25, 26, 27, 28, 29, 30, 31, 23, 33, 34, 35, 36, 37, 38, 39, or 40) nucleotides, and where one of the strands of the siNA molecule comprises at least about 15 (e.g. about 15, 16, 17, 18, 19, 20, 21, 22, 23, 24 or 25 or more) nucleotides that are complementary to the nucleic acid sequence of the RSV target gene or a portion thereof.

In one embodiment, a siNA molecule of the invention comprises a sense region and an antisense region, wherein the antisense region comprises a nucleotide sequence that is complementary to a nucleotide sequence of RNA encoded by a RSV target gene, or a portion thereof, and the sense region comprises a nucleotide sequence that is complementary to the antisense region. In one embodiment, the siNA molecule is assembled from two separate oligonucleotide fragments, wherein one fragment comprises the sense region and the second fragment comprises the antisense region of the siNA molecule. In another embodiment, the sense region is connected to the antisense region via a linker molecule. In another embodiment, the sense region is connected to the antisense region via a linker molecule, such as a nucleotide or non-nucleotide linker. In one embodiment, each strand of the double stranded siNA molecule comprises at least two (e.g., 2, 3, 4, 5, or more) different chemical modifications, e.g., different nucleotide sugar, base, or backbone modifications. The RSV target gene can comprise, for example, sequences referred herein or incorporated by reference herein In one embodiment, the invention features a double-stranded short interfering nucleic acid (siNA) molecule that down-regulates expression of a RSV target gene or that directs cleavage of a RSV target RNA, comprising a sense region and an antisense region, wherein the antisense region comprises a nucleotide sequence that is complementary to a nucleotide sequence of RNA encoded by the RSV target gene or a portion thereof and the sense region comprises a nucleotide sequence that is complementary to the antisense region, and wherein the siNA molecule has one or more modified pyrimidine and/or purine nucleotides. In one embodiment, each strand of the double stranded siNA molecule comprises at least two (e.g., 2, 3, 4, 5, or more) different chemical modifications, e.g., different nucleotide sugar, base, or backbone modifications. In one embodiment, the pyrimidine nucleotides in the sense region are 2'-O-methylpyrimidine nucleotides or 2'-deoxy-2'-fluoro pyrimidine nucleotides and the purine nucleotides present in the sense region are 2'-deoxy purine nucleotides. In another embodiment, the pyrimidine nucleotides in the sense region are 2'-deoxy-2'-fluoro pyrimidine nucleotides and the purine nucleotides present in the sense region are 2'-O-methyl purine nucleotides. In another embodiment, the pyrimidine nucleotides in the sense region are 2'-deoxy-2'-fluoro pyrimidine nucleotides and the purine nucleotides present in the sense region are 2'-deoxy purine nucleotides. In one embodiment, the pyrimidine nucleotides in the antisense region are 2'-deoxy-2'-fluoro pyrimidine nucleotides and the purine nucleotides present in the antisense region are 2'-O-methyl or 2'-deoxy purine nucleotides. In another embodiment of any of the above-described siNA molecules, any nucleotides present in a non-complementary region of the sense strand (e.g. overhang region) are 2'-deoxy nucleotides.

In one embodiment, the invention features a double-stranded short interfering nucleic acid (siNA) molecule that down-regulates expression of a RSV target gene or that directs cleavage of a RSV target RNA, wherein the siNA molecule is assembled from two separate oligonucleotide fragments wherein one fragment comprises the sense region and the second fragment comprises the antisense region of the siNA molecule, and wherein the fragment comprising the sense region includes a terminal cap moiety at the 5'-end, the 3'-end, or both of the 5' and 3' ends of the fragment. In one embodiment, the terminal cap moiety is an inverted deoxy abasic moiety or glyceryl moiety. In one embodiment, each of the two fragments of the siNA molecule independently comprise about 15 to about 30 (e.g. about 15, 16, 17, 18, 19, 20, 21, 22, 23, 24, 25, 26, 27, 28, 29, or 30) nucleotides. In another embodiment, each of the two fragments of the siNA molecule independently comprise about 15 to about 40 (e.g. about 15, 16, 17, 18, 19, 20, 21, 22, 23, 24, 25, 26, 27, 28, 29, 30, 31, 23, 33, 34, 35, 36, 37, 38, 39, or 40) nucleotides. In a non-limiting example, each of the two fragments of the siNA molecule comprise about 21 nucleotides.

In one embodiment, the invention features a siNA molecule comprising at least one modified nucleotide, wherein the modified nucleotide is a 2'-deoxy-2'-fluoro nucleotide, 2'-deoxy-2'-fluoroarabino, 2'-O-trifluoromethyl nucleotide, 2'-O-ethyl-trifluoromethoxy nucleotide, or 2'-O-difluoromethoxy-ethoxy nucleotide or any other modified nucleoside/nucleotide described herein and in U.S. Ser. No. 10/981, 966, filed Nov. 5, 2004, incorporated by reference herein. In one embodiment, the invention features a siNA molecule comprising at least two (e.g., 2, 3, 4, 5, 6, 7, 8, 9, 10, or more) modified nucleotides, wherein the modified nucleotide is selected from the group consisting of 2'-deoxy-2'-fluoro nucleotide, 2'-deoxy-2'-fluoroarabino, 2'-O-trifluoromethyl nucleotide, 2'-O-ethyl-trifluoromethoxy nucleotide, or 2'-O-difluoromethoxy-ethoxy nucleotide or any other modified nucleoside/nucleotide described herein and in U.S. Ser. No. 10/981,966, filed Nov. 5, 2004, incorporated by reference herein. The modified nucleotide/nucleoside can be the same or different. The siNA can be, for example, about 15 to about 40 nucleotides in length.

In one embodiment, all pyrimidine nucleotides present in the siNA are 2'-deoxy-2'-fluoro, 2'-deoxy-2'-fluoroarabino, 2'-O-trifluoromethyl, 2'-O-ethyl-trifluoromethoxy, or 2'-O-difluoromethoxy-ethoxy, 4'-thio pyrimidine nucleotides. In one embodiment, the modified nucleotides in the siNA include at least one 2'-deoxy-2'-fluoro cytidine or 2'-deoxy-2'-fluoro uridine nucleotide. In another embodiment, the modified nucleotides in the siNA include at least one 2'-deoxy-2'-fluoro cytidine and at least one 2'-deoxy-2'-fluoro uridine nucleotides.

In one embodiment, all uridine nucleotides present in the siNA are 2'-deoxy-2'-fluoro uridine nucleotides. In one embodiment, all cytidine nucleotides present in the siNA are 2'-deoxy-2'-fluoro cytidine nucleotides. In one embodiment, all adenosine nucleotides present in the siNA are 2'-deoxy-2'-fluoro adenosine nucleotides. In one embodiment, all guanosine nucleotides present in the siNA are 2'-deoxy-2'-fluoro guanosine nucleotides. The siNA can further comprise at least one modified internucleotidic linkage, such as phosphorothioate linkage. In one embodiment, the 2'-deoxy-2'-fluoronucleotides are present at specifically selected locations in the siNA that are sensitive to cleavage by ribonucleases, such as locations having pyrimidine nucleotides.

In one embodiment, the invention features a method of increasing the stability of a siNA molecule against cleavage by ribonucleases comprising introducing at least one modified nucleotide into the siNA molecule, wherein the modified nucleotide is a 2'-deoxy-2'-fluoro nucleotide. In one embodiment, all pyrimidine nucleotides present in the siNA are 2'-deoxy-2'-fluoro pyrimidine nucleotides. In one embodiment, the modified nucleotides in the siNA include at least one 2'-deoxy-2'-fluoro cytidine or 2'-deoxy-2'-fluoro uridine nucleotide. In another embodiment, the modified nucleotides in the siNA include at least one 2'-fluoro cytidine and at least one 2'-deoxy-2'-fluoro uridine nucleotides. In one embodiment, all uridine nucleotides present in the siNA are 2'-deoxy-2'-fluoro uridine nucleotides. In one embodiment, all cytidine nucleotides present in the siNA are 2'-deoxy-2'-fluoro cytidine nucleotides. In one embodiment, all adenosine nucleotides present in the siNA are 2'-deoxy-2'-fluoro adenosine nucleotides. In one embodiment, all guanosine nucleotides present in the siNA are 2'-deoxy-2'-fluoro guanosine nucleotides. The siNA can further comprise at least one modified internucleotidic linkage, such as a phosphorothioate linkage. In one embodiment, the 2'-deoxy-2'-fluoronucleotides are present at specifically selected locations in the siNA that are sensitive to cleavage by ribonucleases, such as locations having pyrimidine nucleotides.

In one embodiment, the invention features a method of increasing the stability of a siNA molecule against cleavage by ribonucleases comprising introducing at least one modified nucleotide into the siNA molecule, wherein the modified nucleotide is a 2'-deoxy-2'-fluoroarabino nucleotide. In one embodiment, all pyrimidine nucleotides present in the siNA are 2'-deoxy-2'-fluoroarabino pyrimidine nucleotides. In one embodiment, the modified nucleotides in the siNA include at least one 2'-deoxy-2'-fluoroarabino cytidine or 2'-deoxy-2'-fluoroarabino uridine nucleotide. In another embodiment, the modified nucleotides in the siNA include at least one 2'-fluoro cytidine and at least one 2'-deoxy-2'-fluoroarabino uridine nucleotides. In one embodiment, all uridine nucleotides present in the siNA are 2'-deoxy-2'-fluoroarabino uridine nucleotides. In one embodiment, all cytidine nucleotides present in the siNA are 2'-deoxy-2'-fluoroarabino cytidine nucleotides. In one embodiment, all adenosine nucleotides present in the siNA are 2'-deoxy-2'-fluoroarabino adenosine nucleotides. In one embodiment, all guanosine nucleotides present in the siNA are 2'-deoxy-2'-fluoroarabino guanosine nucleotides. The siNA can further comprise at least one modified internucleotidic linkage, such as a phosphorothioate linkage. In one embodiment, the 2'-deoxy-2'-fluoroarabinonucleotides are present at specifically selected locations in the siNA that are sensitive to cleavage by ribonucleases, such as locations having pyrimidine nucleotides.

In one embodiment, the invention features a double-stranded short interfering nucleic acid (siNA) molecule that down-regulates expression of a RSV target gene or that directs cleavage of a RSV target RNA, comprising a sense region and an antisense region, wherein the antisense region comprises a nucleotide sequence that is complementary to a nucleotide sequence of RNA encoded by the RSV target gene or a portion thereof and the sense region comprises a nucleotide sequence that is complementary to the antisense region, and wherein the purine nucleotides present in the antisense region comprise 2'-deoxy-purine nucleotides. In an alternative embodiment, the purine nucleotides present in the antisense region comprise 2'-O-methyl purine nucleotides. In either of the above embodiments, the antisense region can comprise a phosphorothioate internucleotide linkage at the 3' end of the antisense region. Alternatively, in either of the above embodiments, the antisense region can comprise a glyceryl modification at the 3' end of the antisense region. In another embodiment of any of the above-described siNA molecules, any nucleotides present in a non-complementary region of the antisense strand (e.g. overhang region) are 2'-deoxy nucleotides.

In one embodiment, the antisense region of a siNA molecule of the invention comprises sequence complementary to a portion of an endogenous transcript having sequence unique to a particular viral strain, or disease or trait related allele in a subject or organism, such as sequence comprising a single nucleotide polymorphism (SNP) associated with the virus, or the disease or trait specific allele. As such, the antisense region of a siNA molecule of the invention can comprise sequence complementary to sequences that are unique to a particular allele to provide specificity in mediating selective RNAi against the disease, condition, or trait related allele.

In one embodiment, the invention features a double-stranded short interfering nucleic acid (siNA) molecule that down-regulates expression of a RSV target gene or that directs cleavage of a RSV target RNA, wherein the siNA molecule is assembled from two separate oligonucleotide fragments wherein one fragment comprises the sense region and the second fragment comprises the antisense region of the siNA molecule. In one embodiment, each strand of the double stranded siNA molecule is about 21 nucleotides long where about 19 nucleotides of each fragment of the siNA molecule are base-paired to the complementary nucleotides of the other fragment of the siNA molecule, wherein at least two 3' terminal nucleotides of each fragment of the siNA molecule are not base-paired to the nucleotides of the other fragment of the siNA molecule. In another embodiment, the siNA molecule is a double stranded nucleic acid molecule, where each strand is about 19 nucleotide long and where the nucleotides of each fragment of the siNA molecule are base-paired to the complementary nucleotides of the other fragment of the siNA molecule to form at least about 15 (e.g., 15, 16, 17, 18, or 19) base pairs, wherein one or both ends of the siNA molecule are blunt ends. In one embodiment, each of the two 3' terminal nucleotides of each fragment of the siNA molecule is a 2'-deoxy-pyrimidine nucleotide, such as a 2'-deoxy-thymidine. In another embodiment, all nucleotides of each fragment of the siNA molecule are base-paired to the complementary nucleotides of the other fragment of the siNA molecule. In another embodiment, the siNA molecule is a double stranded nucleic acid molecule of about 19 to about 25 base pairs having a sense region and an antisense region, where about 19 nucleotides of the antisense region are base-paired to the nucleotide sequence or a portion thereof of the RNA encoded by the RSV target gene. In another embodiment, about 21 nucleotides of the antisense region are base-paired to the nucleotide sequence or a portion thereof of the RNA encoded by the RSV target gene. In any of the above embodiments, the 5'-end of the fragment comprising said antisense region can optionally include a phosphate group.

In one embodiment, the invention features a double-stranded short interfering nucleic acid (siNA) molecule that inhibits the expression of a RSV target RNA sequence, wherein the siNA molecule does not contain any ribonucleotides and wherein each strand of the double-stranded siNA molecule is about 15 to about 30 nucleotides. In one embodiment, the siNA molecule is 21 nucleotides in length. Examples of non-ribonucleotide containing siNA constructs are combinations of stabilization chemistries shown in Table IV in any combination of Sense/Antisense chemistries, such as Stab 7/8, Stab 7/11, Stab 8/8, Stab 18/8, Stab 18/11, Stab 12/13, Stab 7/13, Stab 18/13, Stab 7/19, Stab 8/19, Stab 18/19, Stab 7/20, Stab 8/20, Stab 18/20, Stab 7/32, Stab 8/32, or Stab 18/32 (e.g., any siNA having Stab 7, 8, 11, 12, 13, 14, 15, 17, 18, 19, 20, or 32 sense or antisense strands or any combination thereof). Herein, numeric Stab chemistries can include both 2'-fluoro and 2'-OCF3 versions of the chemistries shown in Table IV. For example, "Stab 7/8" refers to both Stab 7/8 and Stab 7F/8F etc. In one embodiment, the invention features a chemically synthesized double stranded RNA molecule that directs cleavage of a RSV target RNA via RNA interference, wherein each strand of said RNA molecule is about 15 to about 30 nucleotides in length; one strand of the RNA molecule comprises nucleotide sequence having sufficient complementarity to the RSV target RNA for the RNA molecule to direct cleavage of the RSV target RNA via RNA interference; and wherein at least one strand of the RNA molecule optionally comprises one or more chemically modified nucleotides described herein, such as without limitation deoxynucleotides, 2'-O-methyl nucleotides, 2'-deoxy-2'-fluoro nucleotides, 2'-deoxy-2'-fluoroarabino, 2'-O-methoxyethyl nucleotides, 4'-thio nucleotides, 2'-O-trifluoromethyl nucleotides, 2'-O-ethyl-trifluoromethoxy nucleotides, 2'-O-difluoromethoxy-ethoxy nucleotides, etc. or any combination thereof.

In one embodiment, a RSV target RNA of the invention comprises sequence encoding a protein.

In one embodiment, RSV target RNA of the invention comprises non-coding RNA sequence (e.g., miRNA, snRNA, siRNA etc.), see for example Mattick, 2005, *Science*, 309, 1527-1528; Clayerie, 2005, *Science*, 309, 1529-1530; Sethupathy et al., 2006, RNA, 12, 192-197; and Czech, 2006 NEJM, 354, 11: 1194-1195.

In one embodiment, the invention features a medicament comprising a siNA molecule of the invention.

In one embodiment, the invention features an active ingredient comprising a siNA molecule of the invention.

In one embodiment, the invention features the use of a double-stranded short interfering nucleic acid (siNA) molecule to inhibit, down-regulate, or reduce expression of a RSV target gene, wherein the siNA molecule comprises one or more chemical modifications and each strand of the double-stranded siNA is independently about 15 to about 30 or more (e.g., about 15, 16, 17, 18, 19, 20, 21, 22, 23, 24, 25, 26, 27, 28, 29 or 30 or more) nucleotides long. In one embodiment, the siNA molecule of the invention is a double stranded nucleic acid molecule comprising one or more chemical modifications, where each of the two fragments of the siNA molecule independently comprise about 15 to about 40 (e.g. about 15, 16, 17, 18, 19, 20, 21, 22, 23, 24, 25, 26, 27, 28, 29, 30, 31, 23, 33, 34, 35, 36, 37, 38, 39, or 40) nucleotides and where one of the strands comprises at least 15 nucleotides that are complementary to nucleotide sequence of RSV target encoding RNA or a portion thereof. In a non-limiting example, each of the two fragments of the siNA molecule comprise about 21 nucleotides. In another embodiment, the siNA molecule is a double stranded nucleic acid molecule comprising one or more chemical modifications, where each strand is about 21 nucleotide long and where about 19 nucleotides of each fragment of the siNA molecule are base-paired to the complementary nucleotides of the other fragment of the siNA molecule, wherein at least two 3' terminal nucleotides of each fragment of the siNA molecule are not base-paired to the nucleotides of the other fragment of the siNA molecule. In another embodiment, the siNA molecule is a double stranded nucleic acid molecule comprising one or more chemical modifications, where each strand is about 19 nucleotide long and where the nucleotides of each fragment of the siNA molecule are base-paired to the complementary nucleotides of the other fragment of the siNA molecule to form at least about 15 (e.g., 15, 16, 17, 18, or 19) base pairs, wherein one or both ends of the siNA molecule are blunt ends. In one embodiment, each of the two 3' terminal nucleotides of each fragment of the siNA molecule is a 2'-deoxy-pyrimidine nucleotide, such as a 2'-deoxy-thymidine. In another embodiment, all nucleotides of each fragment of the siNA molecule are base-paired to the complementary nucleotides of the other fragment of the siNA molecule. In another embodiment, the siNA molecule is a double stranded nucleic acid molecule of about 19 to about 25 base pairs having a sense region and an antisense region and comprising one or more chemical modifications, where about 19 nucleotides of the antisense region are base-paired to the nucleotide sequence or a portion thereof of the RNA encoded by the RSV target gene. In another embodiment, about 21 nucleotides of the antisense region are base-paired to the nucleotide sequence or a portion thereof of the RNA encoded by the RSV target gene. In any of the above embodiments, the 5'-end of the fragment comprising said antisense region can optionally include a phosphate group.

In one embodiment, the invention features the use of a double-stranded short interfering nucleic acid (siNA) molecule that inhibits, down-regulates, or reduces expression of a RSV target gene, wherein one of the strands of the double-stranded siNA molecule is an antisense strand which comprises nucleotide sequence that is complementary to nucleotide sequence of RSV target RNA or a portion thereof, the other strand is a sense strand which comprises nucleotide sequence that is complementary to a nucleotide sequence of the antisense strand. In one embodiment, each strand has at least two (e.g., 2, 3, 4, 5, or more) chemical modifications, which can be the same or different, such as nucleotide, sugar, base, or backbone modifications. In one embodiment, a majority of the pyrimidine nucleotides present in the double-stranded siNA molecule comprises a sugar modification. In one embodiment, a majority of the purine nucleotides present in the double-stranded siNA molecule comprises a sugar modification.

In one embodiment, the invention features a double-stranded short interfering nucleic acid (siNA) molecule that inhibits, down-regulates, or reduces expression of a RSV target gene, wherein one of the strands of the double-stranded siNA molecule is an antisense strand which comprises nucleotide sequence that is complementary to nucleotide sequence of RSV target RNA or a portion thereof, wherein the other strand is a sense strand which comprises nucleotide sequence that is complementary to a nucleotide sequence of the antisense strand. In one embodiment, each strand has at least two (e.g., 2, 3, 4, 5, or more) chemical modifications, which can be the same or different, such as nucleotide, sugar, base, or backbone modifications. In one embodiment, a majority of the pyrimidine nucleotides present in the double-stranded siNA molecule comprises a sugar modification. In one embodiment, a majority of the purine nucleotides present in the double-stranded siNA molecule comprises a sugar modification.

In one embodiment, the invention features a double-stranded short interfering nucleic acid (siNA) molecule that inhibits, down-regulates, or reduces expression of a RSV target gene, wherein one of the strands of the double-stranded siNA molecule is an antisense strand which comprises nucleotide sequence that is complementary to nucleotide sequence of RSV target RNA that encodes a protein or portion thereof, the other strand is a sense strand which comprises nucleotide sequence that is complementary to a nucleotide sequence of the antisense strand and wherein a majority of the pyrimidine nucleotides present in the double-stranded siNA molecule comprises a sugar modification. In one embodiment, each strand of the siNA molecule comprises about 15 to about 30 or more (e.g., about 15, 16, 17, 18, 19, 20, 21, 22, 23, 24, 25, 26, 27, 28, 29, or 30 or more) nucleotides, wherein each strand comprises at least about 15 nucleotides that are complementary to the nucleotides of the other strand. In one embodiment, the siNA molecule is assembled from two oligonucleotide fragments, wherein one fragment comprises the nucleotide sequence of the antisense strand of the siNA molecule and a second fragment comprises nucleotide sequence of the sense region of the siNA molecule. In one embodiment, the sense strand is connected to the antisense strand via a linker molecule, such as a polynucleotide linker or a non-nucleotide linker. In a further embodiment, the pyrimidine nucleotides present in the sense strand are 2'-deoxy-2'fluoro pyrimidine nucleotides and the purine nucleotides present in the sense region are 2'-deoxy purine nucleotides. In another embodiment, the pyrimidine nucleotides present in the sense strand are 2'-deoxy-2'fluoro pyrimidine nucleotides and the purine nucleotides present in the sense region are 2'-O-methyl purine nucleotides. In still another embodiment, the pyrimidine nucleotides present in the antisense strand are 2'-deoxy-2'-fluoro pyrimidine nucleotides and any purine nucleotides present in the antisense strand are 2'-deoxy purine nucleotides. In another embodiment, the antisense strand comprises one or more 2'-deoxy-2'-fluoro pyrimidine nucleotides and one or more 2'-O-methyl purine nucleotides. In another embodiment, the pyrimidine nucleotides present in the antisense strand are 2'-deoxy-2'-fluoro pyrimidine nucleotides and any purine nucleotides present in the antisense strand are 2'-O-methyl purine nucleotides. In a further embodiment the sense strand comprises a 3'-end and a 5'-end, wherein a terminal cap moiety (e.g., an inverted deoxy abasic moiety or inverted deoxy nucleotide moiety such as inverted thymidine) is present at the 5'-end, the 3'-end, or both of the 5' and 3' ends of the sense strand. In another embodiment, the antisense strand comprises a phosphorothioate internucleotide linkage at the 3' end of the antisense strand. In another embodiment, the antisense strand comprises a glyceryl modification at the 3' end. In another embodiment, the 5'-end of the antisense strand optionally includes a phosphate group.

In any of the above-described embodiments of a double-stranded short interfering nucleic acid (siNA) molecule that inhibits expression of a RSV target gene, wherein a majority of the pyrimidine nucleotides present in the double-stranded siNA molecule comprises a sugar modification, each of the two strands of the siNA molecule can comprise about 15 to about 30 or more (e.g., about 15, 16, 17, 18, 19, 20, 21, 22, 23, 24, 25, 26, 27, 28, 29, or 30 or more) nucleotides. In one embodiment, about 15 to about 30 or more (e.g., about 15, 16, 17, 18, 19, 20, 21, 22, 23, 24, 25, 26, 27, 28, 29, or 30 or more) nucleotides of each strand of the siNA molecule are base-paired to the complementary nucleotides of the other strand of the siNA molecule. In another embodiment, about 15 to about 30 or more (e.g., about 15, 16, 17, 18, 19, 20, 21, 22, 23, 24, 25, 26, 27, 28, 29, or 30 or more) nucleotides of each strand of the siNA molecule are base-paired to the complementary nucleotides of the other strand of the siNA molecule, wherein at least two 3' terminal nucleotides of each strand of the siNA molecule are not base-paired to the nucleotides of the other strand of the siNA molecule. In another embodiment, each of the two 3' terminal nucleotides of each fragment of the siNA molecule is a 2'-deoxy-pyrimidine, such as 2'-deoxy-thymidine. In one embodiment, each strand of the siNA molecule is base-paired to the complementary nucleotides of the other strand of the siNA molecule. In one embodiment, about 15 to about 30 (e.g., about 15, 16, 17, 18, 19, 20, 21, 22, 23, 24, 25, 26, 27, 28, 29, or 30) nucleotides of the antisense strand are base-paired to the nucleotide sequence of the RSV target RNA or a portion thereof. In one embodiment, about 18 to about 25 (e.g., about 18, 19, 20, 21, 22, 23, 24, or 25) nucleotides of the antisense strand are base-paired to the nucleotide sequence of the RSV target RNA or a portion thereof.

In one embodiment, the invention features a double-stranded short interfering nucleic acid (siNA) molecule that inhibits expression of a RSV target gene, wherein one of the strands of the double-stranded siNA molecule is an antisense strand which comprises nucleotide sequence that is complementary to nucleotide sequence of RSV target RNA or a portion thereof, the other strand is a sense strand which comprises nucleotide sequence that is complementary to a nucleotide sequence of the antisense strand. In one embodiment, each strand has at least two (e.g., 2, 3, 4, 5, or more) different chemical modifications, such as nucleotide sugar, base, or backbone modifications. In one embodiment, a majority of the pyrimidine nucleotides present in the double-stranded siNA molecule comprises a sugar modification. In one embodiment, a majority of the purine nucleotides present in the double-stranded siNA molecule comprises a sugar modification. In one embodiment, the 5'-end of the antisense strand optionally includes a phosphate group.

In one embodiment, the invention features a double-stranded short interfering nucleic acid (siNA) molecule that inhibits expression of a RSV target gene, wherein one of the strands of the double-stranded siNA molecule is an antisense strand which comprises nucleotide sequence that is complementary to nucleotide sequence of RSV target RNA or a portion thereof, the other strand is a sense strand which comprises nucleotide sequence that is complementary to a nucleotide sequence of the antisense strand and wherein a majority of the pyrimidine nucleotides present in the double-stranded siNA molecule comprises a sugar modification, and wherein the nucleotide sequence or a portion thereof of the antisense strand is complementary to a nucleotide sequence of the untranslated region or a portion thereof of the RSV target RNA.

In one embodiment, the invention features a double-stranded short interfering nucleic acid (siNA) molecule that inhibits expression of a RSV target gene, wherein one of the strands of the double-stranded siNA molecule is an antisense strand which comprises nucleotide sequence that is complementary to nucleotide sequence of RSV target RNA or a portion thereof, wherein the other strand is a sense strand which comprises nucleotide sequence that is complementary to a nucleotide sequence of the antisense strand, wherein a majority of the pyrimidine nucleotides present in the double-stranded siNA molecule comprises a sugar modification, and wherein the nucleotide sequence of the antisense strand is complementary to a nucleotide sequence of the RSV target RNA or a portion thereof that is present in the RSV target RNA.

In one embodiment, the invention features a composition comprising a siNA molecule of the invention in a pharmaceutically acceptable carrier or diluent. In another embodiment, the invention features two or more differing siNA molecules of the invention (e.g. siNA molecules that target different regions of RSV target RNA or siNA molecules that target RSV RNA and cellular targets) in a pharmaceutically acceptable carrier or diluent.

In a non-limiting example, the introduction of chemically-modified nucleotides into nucleic acid molecules provides a powerful tool in overcoming potential limitations of in vivo stability and bioavailability inherent to native RNA molecules that are delivered exogenously. For example, the use of chemically-modified nucleic acid molecules can enable a lower dose of a particular nucleic acid molecule for a given therapeutic effect since chemically-modified nucleic acid molecules tend to have a longer half-life in serum. Furthermore, certain chemical modifications can improve the bioavailability of nucleic acid molecules by RSV targeting particular cells or tissues and/or improving cellular uptake of the nucleic acid molecule. Therefore, even if the activity of a chemically-modified nucleic acid molecule is reduced as compared to a native nucleic acid molecule, for example, when compared to an all-RNA nucleic acid molecule, the overall activity of the modified nucleic acid molecule can be greater than that of the native molecule due to improved stability and/or delivery of the molecule. Unlike native unmodified siNA, chemically-modified siNA can also minimize the possibility of activating interferon activity in humans.

In any of the embodiments of siNA molecules described herein, the antisense region of a siNA molecule of the invention can comprise a phosphorothioate internucleotide linkage at the 3'-end of said antisense region. In any of the embodiments of siNA molecules described herein, the antisense region can comprise about one to about five phosphorothioate internucleotide linkages at the 5'-end of said antisense region. In any of the embodiments of siNA molecules described herein, the 3'-terminal nucleotide overhangs of a siNA molecule of the invention can comprise ribonucleotides or deoxyribonucleotides that are chemically-modified at a nucleic acid sugar, base, or backbone. In any of the embodiments of siNA molecules described herein, the 3'-terminal nucleotide overhangs can comprise one or more universal base ribonucleotides. In any of the embodiments of siNA molecules described herein, the 3'-terminal nucleotide overhangs can comprise one or more acyclic nucleotides.

One embodiment of the invention provides an expression vector comprising a nucleic acid sequence encoding at least one siNA molecule of the invention in a manner that allows expression of the nucleic acid molecule. Another embodiment of the invention provides a mammalian cell comprising such an expression vector. The mammalian cell can be a human cell. The siNA molecule of the expression vector can comprise a sense region and an antisense region. The antisense region can comprise sequence complementary to a RNA or DNA sequence encoding a RSV target and the sense region can comprise sequence complementary to the antisense region. The siNA molecule can comprise two distinct strands having complementary sense and antisense regions. The siNA molecule can comprise a single strand having complementary sense and antisense regions.

In one embodiment, the invention features a chemically-modified short interfering nucleic acid (siNA) molecule capable of mediating RNA interference (RNAi) inside a cell or reconstituted in vitro system, wherein the chemical modification comprises one or more (e.g., about 1, 2, 3, 4, 5, 6, 7, 8, 9, 10, or more) nucleotides comprising a backbone modified internucleotide linkage having Formula I:

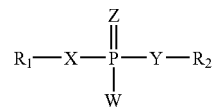

wherein each R1 and R2 is independently any nucleotide, non-nucleotide, or polynucleotide which can be naturally-occurring or chemically-modified and which can be included in the structure of the siNA molecule or serve as a point of attachment to the siNA molecule, each X and Y is independently O, S, N, alkyl, or substituted alkyl, each Z and W is independently O, S, N, alkyl, substituted alkyl, O-alkyl, S-alkyl, alkaryl, aralkyl, or acetyl and wherein W, X, Y, and Z are optionally not all O. In another embodiment, a backbone modification of the invention comprises a phosphonoacetate and/or thiophosphonoacetate internucleotide linkage (see for example Sheehan et al., 2003, Nucleic Acids Research, 31, 4109-4118).

The chemically-modified internucleotide linkages having Formula I, for example, wherein any Z, W, X, and/or Y independently comprises a sulphur atom, can be present in one or both oligonucleotide strands of the siNA duplex, for example, in the sense strand, the antisense strand, or both strands. The siNA molecules of the invention can comprise one or more (e.g., about 1, 2, 3, 4, 5, 6, 7, 8, 9, 10, or more) chemically-modified internucleotide linkages having Formula I at the 3'-end, the 5'-end, or both of the 3' and 5'-ends of the sense strand, the antisense strand, or both strands. For example, an exemplary siNA molecule of the invention can comprise about 1 to about 5 or more (e.g., about 1, 2, 3, 4, 5, or more) chemically-modified internucleotide linkages having Formula I at the 5'-end of the sense strand, the antisense strand, or both strands. In another non-limiting example, an exemplary siNA molecule of the invention can comprise one or more (e.g., about 1, 2, 3, 4, 5, 6, 7, 8, 9, 10, or more) pyrimidine nucleotides with chemically-modified internucleotide linkages having Formula I in the sense strand, the antisense strand, or both strands. In yet another non-limiting example, an exemplary siNA molecule of the invention can comprise one or more (e.g., about 1, 2, 3, 4, 5, 6, 7, 8, 9, 10, or more) purine nucleotides with chemically-modified internucleotide linkages having Formula I in the sense strand, the antisense strand, or both strands. In another embodiment, a siNA molecule of the invention having internucleotide linkage(s) of Formula I also comprises a chemically-modified nucleotide or non-nucleotide having any of Formulae I-VII.

In one embodiment, the invention features a chemically-modified short interfering nucleic acid (siNA) molecule capable of mediating RNA interference (RNAi) inside a cell or reconstituted in vitro system, wherein the chemical modification comprises one or more (e.g., about 1, 2, 3, 4, 5, 6, 7, 8, 9, 10, or more) nucleotides or non-nucleotides having Formula II:

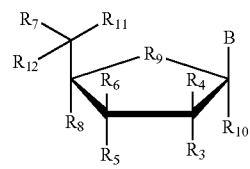

wherein each R3, R4, R5, R6, R7, R8, R10, R11 and R12 is independently H, OH, alkyl, substituted alkyl, alkaryl or aralkyl, F, Cl, Br, CN, CF3, OCF3, OCN, O-alkyl, S-alkyl, N-alkyl, O-alkenyl, S-alkenyl, N-alkenyl, SO-alkyl, alkyl-SH, alkyl-OH, O-alkyl-OH, O-alkyl-SH, S-alkyl-OH, S-alkyl-SH, alkyl-S-alkyl, alkyl-O-alkyl, ONO2, NO2, N3, NH2, aminoalkyl, aminoacid, aminoacyl, ONH2, O-aminoalkyl, O-aminoacid, O-aminoacyl, heterocycloalkyl, heterocycloalkaryl, aminoalkylamino, polyalklylamino, substituted silyl, or a group having any of Formula I, II, III, IV, V, VI and/or VII, any of which can be included in the structure of the siNA molecule or serve as a point of attachment to the siNA molecule; R9 is O, S, CH2, S=O, CHF, or CF2, and B is a nucleosidic base such as adenine, guanine, uracil, cytosine, thymine, 2-aminoadenosine, 5-methylcytosine, 2,6-diaminopurine, or any other non-naturally occurring base that can be employed to be complementary or non-complementary to target RNA or a non-nucleosidic base such as phenyl, naphthyl, 3-nitropyrrole, 5-nitroindole, nebularine, pyridone, pyridinone, or any other non-naturally occurring universal base that can be complementary or non-complementary to target RNA. In one embodiment, R3 and/or R7 comprises a conjugate moiety and a linker (e.g., a nucleotide or non-nucleotide linker as described herein or otherwise known in the art). Non-limiting examples of conjugate moieties include ligands for cellular receptors, such as peptides derived from naturally occurring protein ligands; protein localization sequences, including cellular ZIP code sequences; antibodies; nucleic acid aptamers; vitamins and other co-factors, such as folate and N-acetylgalactosamine; polymers, such as polyethyleneglycol (PEG); phospholipids; cholesterol; steroids, and polyamines, such as PEI, spermine or spermidine.

The chemically-modified nucleotide or non-nucleotide of Formula II can be present in one or both oligonucleotide strands of the siNA duplex, for example in the sense strand, the antisense strand, or both strands. The siNA molecules of the invention can comprise one or more chemically-modified nucleotides or non-nucleotides of Formula II at the 3'-end, the 5'-end, or both of the 3' and 5'-ends of the sense strand, the antisense strand, or both strands. For example, an exemplary siNA molecule of the invention can comprise about 1 to about 5 or more (e.g., about 1, 2, 3, 4, 5, or more) chemically-modified nucleotides or non-nucleotides of Formula II at the 5'-end of the sense strand, the antisense strand, or both strands. In another non-limiting example, an exemplary siNA molecule of the invention can comprise about 1 to about 5 or more (e.g., about 1, 2, 3, 4, 5, or more) chemically-modified nucleotides or non-nucleotides of Formula II at the 3'-end of the sense strand, the antisense strand, or both strands.

In one embodiment, the invention features a chemically-modified short interfering nucleic acid (siNA) molecule capable of mediating RNA interference (RNAi) inside a cell or reconstituted in vitro system, wherein the chemical modification comprises one or more (e.g., about 1, 2, 3, 4, 5, 6, 7, 8, 9, 10, or more) nucleotides or non-nucleotides having Formula III:

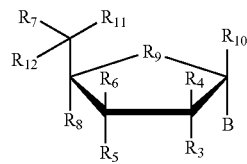

wherein each R3, R4, R5, R6, R7, R8, R10, R11 and R12 is independently H, OH, alkyl, substituted alkyl, alkaryl or aralkyl, F, Cl, Br, CN, CF3, OCF3, OCN, O-alkyl, S-alkyl, N-alkyl, O-alkenyl, S-alkenyl, N-alkenyl, SO-alkyl, alkyl-SH, alkyl-OH, O-alkyl-OH, O-alkyl-SH, S-alkyl-OH, S-alkyl-SH, alkyl-5-alkyl, alkyl-O-alkyl, ONO2, NO2, N3, NH2, aminoalkyl, aminoacid, aminoacyl, ONH2, O-aminoalkyl, O-aminoacid, O-aminoacyl, heterocycloalkyl, heterocycloalkaryl, aminoalkylamino, polyalklylamino, substituted silyl, or a group having any of Formula I, II, III, IV, V, VI and/or VII, any of which can be included in the structure of the siNA molecule or serve as a point of attachment to the siNA molecule; R9 is O, S, CH2, S=O, CHF, or CF2, and B is a nucleosidic base such as adenine, guanine, uracil, cytosine, thymine, 2-aminoadenosine, 5-methylcytosine, 2,6-diaminopurine, or any other non-naturally occurring base that can be employed to be complementary or non-complementary to target RNA or a non-nucleosidic base such as phenyl, naphthyl, 3-nitropyrrole, 5-nitroindole, nebularine, pyridone, pyridinone, or any other non-naturally occurring universal base that can be complementary or non-complementary to target RNA. In one embodiment, R3 and/or R7 comprises a conjugate moiety and a linker (e.g., a nucleotide or non-nucleotide linker as described herein or otherwise known in the art). Non-limiting examples of conjugate moieties include ligands for cellular receptors, such as peptides derived from naturally occurring protein ligands; protein localization sequences, including cellular ZIP code sequences; antibodies; nucleic acid aptamers; vitamins and other co-factors, such as folate and N-acetylgalactosamine; polymers, such as polyethyleneglycol (PEG); phospholipids; cholesterol; steroids, and polyamines, such as PEI, spermine or spermidine.

The chemically-modified nucleotide or non-nucleotide of Formula III can be present in one or both oligonucleotide strands of the siNA duplex, for example, in the sense strand, the antisense strand, or both strands. The siNA molecules of the invention can comprise one or more chemically-modified nucleotides or non-nucleotides of Formula III at the 3'-end, the 5'-end, or both of the 3' and 5'-ends of the sense strand, the antisense strand, or both strands. For example, an exemplary siNA molecule of the invention can comprise about 1 to about 5 or more (e.g., about 1, 2, 3, 4, 5, or more) chemically-modified nucleotide(s) or non-nucleotide(s) of Formula III at the 5'-end of the sense strand, the antisense strand, or both strands. In another non-limiting example, an exemplary siNA molecule of the invention can comprise about 1 to about 5 or more (e.g., about 1, 2, 3, 4, 5, or more) chemically-modified nucleotide or non-nucleotide of Formula III at the 3'-end of the sense strand, the antisense strand, or both strands.

In another embodiment, a siNA molecule of the invention comprises a nucleotide having Formula II or III, wherein the nucleotide having Formula II or III is in an inverted configuration. For example, the nucleotide having Formula II or III is connected to the siNA construct in a 3'-3',3'-2',2'-3', or 5'-5' configuration, such as at the 3'-end, the 5'-end, or both of the 3' and 5'-ends of one or both siNA strands.

In one embodiment, the invention features a chemically-modified short interfering nucleic acid (siNA) molecule capable of mediating RNA interference (RNAi) inside a cell or reconstituted in vitro system, wherein the chemical modification comprises a 5'-terminal phosphate group having Formula IV:

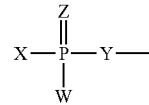

wherein each X and Y is independently O, S, N, alkyl, substituted alkyl, or alkylhalo; wherein each Z and W is independently O, S, N, alkyl, substituted alkyl, O-alkyl, S-alkyl, alkaryl, aralkyl, alkylhalo, or acetyl; and wherein W, X, Y and Z are optionally not all O and Y serves as a point of attachment to the siNA molecule.

In one embodiment, the invention features a siNA molecule having a 5'-terminal phosphate group having Formula IV on the RSV target-complementary strand, for example, a strand complementary to a RSV target RNA, wherein the siNA molecule comprises an all RNA siNA molecule. In another embodiment, the invention features a siNA molecule having a 5'-terminal phosphate group having Formula IV on the RSV target-complementary strand wherein the siNA molecule also comprises about 1 to about 3 (e.g., about 1, 2, or 3) nucleotide 3'-terminal nucleotide overhangs having about 1 to about 4 (e.g., about 1, 2, 3, or 4) deoxyribonucleotides on the 3'-end of one or both strands. In another embodiment, a 5'-terminal phosphate group having Formula IV is present on the RSV target-complementary strand of a siNA molecule of the invention, for example a siNA molecule having chemical modifications having any of Formulae I-VII.

In one embodiment, the invention features a chemically-modified short interfering nucleic acid (siNA) molecule capable of mediating RNA interference (RNAi) inside a cell or reconstituted in vitro system, wherein the chemical modification comprises one or more phosphorothioate internucleotide linkages. For example, in a non-limiting example, the invention features a chemically-modified short interfering nucleic acid (siNA) having about 1, 2, 3, 4, 5, 6, 7, 8 or more phosphorothioate internucleotide linkages in one siNA strand. In yet another embodiment, the invention features a chemically-modified short interfering nucleic acid (siNA) individually having about 1, 2, 3, 4, 5, 6, 7, 8 or more phosphorothioate internucleotide linkages in both siNA strands. The phosphorothioate internucleotide linkages can be present in one or both oligonucleotide strands of the siNA duplex, for example in the sense strand, the antisense strand, or both strands. The siNA molecules of the invention can comprise one or more phosphorothioate internucleotide linkages at the 3'-end, the 5'-end, or both of the 3'- and 5'-ends of the sense strand, the antisense strand, or both strands. For example, an exemplary siNA molecule of the invention can comprise about 1 to about 5 or more (e.g., about 1, 2, 3, 4, 5, or more) consecutive phosphorothioate internucleotide linkages at the 5'-end of the sense strand, the antisense strand, or both strands. In another non-limiting example, an exemplary siNA molecule of the invention can comprise one or more (e.g., about 1, 2, 3, 4, 5, 6, 7, 8, 9, 10, or more) pyrimidine phosphorothioate internucleotide linkages in the sense strand, the antisense strand, or both strands. In yet another non-limiting example, an exemplary siNA molecule of the invention can comprise one or more (e.g., about 1, 2, 3, 4, 5, 6, 7, 8, 9, 10, or more) purine phosphorothioate internucleotide linkages in the sense strand, the antisense strand, or both strands.

Each strand of the double stranded siNA molecule can have one or more chemical modifications such that each strand comprises a different pattern of chemical modifications. Several non-limiting examples of modification schemes that could give rise to different patterns of modifications are provided herein.

In one embodiment, the invention features a siNA molecule, wherein the sense strand comprises one or more, for example, about 1, 2, 3, 4, 5, 6, 7, 8, 9, 10, or more phosphorothioate internucleotide linkages, and/or one or more (e.g., about 1, 2, 3, 4, 5, 6, 7, 8, 9, 10 or more) 2'-deoxy, 2'-O-methyl, 2'-deoxy-2'-fluoro, 2'-O-trifluoromethyl, 2'-O-ethyl-trifluoromethoxy, 2'-O-difluoromethoxy-ethoxy and/or about one or more (e.g., about 1, 2, 3, 4, 5, 6, 7, 8, 9, 10 or more) universal base modified nucleotides, and optionally a terminal cap molecule at the 3'-end, the 5'-end, or both of the 3'- and 5'-ends of the sense strand; and wherein the antisense strand comprises about 1 to about 10 or more, specifically about 1, 2, 3, 4, 5, 6, 7, 8, 9, 10, or more phosphorothioate internucleotide linkages, and/or one or more (e.g., about 1, 2, 3, 4, 5, 6, 7, 8, 9, 10 or more) 2'-deoxy, 2'-O-methyl, 2'-deoxy-2'-fluoro, 2'-O-trifluoromethyl, 2'-O-ethyl-trifluoromethoxy, 2'-O-difluoromethoxy-ethoxy, 4'-thio and/or one or more (e.g., about 1, 2, 3, 4, 5, 6, 7, 8, 9, 10 or more) universal base modified nucleotides, and optionally a terminal cap molecule at the 3'-end, the 5'-end, or both of the 3'- and 5'-ends of the antisense strand. In another embodiment, one or more, for example about 1, 2, 3, 4, 5, 6, 7, 8, 9, 10, or more, pyrimidine nucleotides of the sense and/or antisense siNA strand are chemically-modified with 2'-deoxy, 2'-O-methyl, 2'-O-trifluoromethyl, 2'-O-ethyl-trifluoromethoxy, 2'-O-difluoromethoxy-ethoxy, 4'-thio and/or 2'-deoxy-2'-fluoro nucleotides, with or without one or more, for example about 1, 2, 3, 4, 5, 6, 7, 8, 9, 10, or more, phosphorothioate internucleotide linkages and/or a terminal cap molecule at the 3'-end, the 5'-end, or both of the 3'- and 5'-ends, being present in the same or different strand.

In another embodiment, the invention features a siNA molecule, wherein the sense strand comprises about 1 to about 5, specifically about 1, 2, 3, 4, or 5 phosphorothioate internucleotide linkages, and/or one or more (e.g., about 1, 2, 3, 4, 5, or more) 2'-deoxy, 2'-O-methyl, 2'-deoxy-2'-fluoro, 2'-O-trifluoromethyl, 2'-O-ethyl-trifluoromethoxy, 2'-O-difluoromethoxy-ethoxy, 4'-thio and/or one or more (e.g., about 1, 2, 3, 4, 5, or more) universal base modified nucleotides, and optionally a terminal cap molecule at the 3-end, the 5'-end, or both of the 3'- and 5'-ends of the sense strand; and wherein the antisense strand comprises about 1 to about 5 or more, specifically about 1, 2, 3, 4, 5, or more phosphorothioate internucleotide linkages, and/or one or more (e.g., about 1, 2, 3, 4, 5, 6, 7, 8, 9, 10 or more) 2'-deoxy, 2'-O-methyl, 2'-deoxy-2'-fluoro, 2'-O-trifluoromethyl, 2'-O-ethyl-trifluoromethoxy, 2'-O-difluoromethoxy-ethoxy, 4'-thio and/or one or more (e.g., about 1, 2, 3, 4, 5, 6, 7, 8, 9, 10 or more) universal base modified nucleotides, and optionally a terminal cap molecule at the 3'-end, the 5'-end, or both of the 3'- and 5'-ends of the antisense strand. In another embodiment, one or more, for example about 1, 2, 3, 4, 5, 6, 7, 8, 9, 10, or more, pyrimidine nucleotides of the sense and/or antisense siNA strand are chemically-modified with 2'-deoxy, 2'-O-methyl, 2'-O-trifluoromethyl, 2'-O-ethyl-trifluoromethoxy, 2'-O-difluoromethoxy-ethoxy, 4'-thio and/or 2'-deoxy-2'-fluoro nucleotides, with or without about 1 to about 5 or more, for example about 1, 2, 3, 4, 5, or more phosphorothioate internucleotide linkages and/or a terminal cap molecule at the 3'-end, the 5'-end, or both of the 3'- and 5'-ends, being present in the same or different strand.

In one embodiment, the invention features a siNA molecule, wherein the sense strand comprises one or more, for example, about 1, 2, 3, 4, 5, 6, 7, 8, 9, 10, or more phosphorothioate internucleotide linkages, and/or about one or more (e.g., about 1, 2, 3, 4, 5, 6, 7, 8, 9, 10 or more) 2'-deoxy, 2'-O-methyl, 2'-deoxy-2'-fluoro, 2'-O-trifluoromethyl, 2'-O-ethyl-trifluoromethoxy, 2'-O-difluoromethoxy-ethoxy, 4'-thio and/or one or more (e.g., about 1, 2, 3, 4, 5, 6, 7, 8, 9, 10 or more) universal base modified nucleotides, and optionally a terminal cap molecule at the 3'-end, the 5'-end, or both of the 3'-and 5'-ends of the sense strand; and wherein the antisense strand comprises about 1 to about 10 or more, specifically about 1, 2, 3, 4, 5, 6, 7, 8, 9, 10 or more phosphorothioate internucleotide linkages, and/or one or more (e.g., about 1, 2, 3, 4, 5, 6, 7, 8, 9, 10 or more) 2'-deoxy, 2'-O-methyl, 2'-deoxy-2'-fluoro, 2'-O-trifluoromethyl, 2'-O-ethyl-trifluoromethoxy, 2'-O-difluoromethoxy-ethoxy, 4'-thio and/or one or more (e.g., about 1, 2, 3, 4, 5, 6, 7, 8, 9, 10 or more) universal base modified nucleotides, and optionally a terminal cap molecule at the 3'-end, the 5'-end, or both of the 3'- and 5'-ends of the antisense strand. In another embodiment, one or more, for example about 1, 2, 3, 4, 5, 6, 7, 8, 9, 10 or more pyrimidine nucleotides of the sense and/or antisense siNA strand are chemically-modified with 2'-deoxy, 2'-O-methyl, 2'-O-trifluoromethyl, 2'-O-ethyl-trifluoromethoxy, 2'-O-difluoromethoxy-ethoxy, 4'-thio and/or 2'-deoxy-2'-fluoro nucleotides, with or without one or more, for example about 1, 2, 3, 4, 5, 6, 7, 8, 9, 10 or more phosphorothioate internucleotide linkages and/or a terminal cap molecule at the 3'-end, the 5'-end, or both of the 3' and 5'-ends, being present in the same or different strand.

In another embodiment, the invention features a siNA molecule, wherein the sense strand comprises about 1 to about 5 or more, specifically about 1, 2, 3, 4, 5 or more phosphorothioate internucleotide linkages, and/or one or more (e.g., about 1, 2, 3, 4, 5, 6, 7, 8, 9, 10 or more) 2'-deoxy, 2'-O-methyl, 2'-deoxy-2'-fluoro, 2'-O-trifluoromethyl, 2'-O-ethyl-trifluoromethoxy, 2'-O-difluoromethoxy-ethoxy, 4'-thio and/or one or more (e.g., about 1, 2, 3, 4, 5, 6, 7, 8, 9, 10 or more) universal base modified nucleotides, and optionally a terminal cap molecule at the 3'-end, the 5'-end, or both of the 3'- and 5'-ends of the sense strand; and wherein the antisense strand comprises about 1 to about 5 or more, specifically about 1, 2, 3, 4, 5 or more phosphorothioate internucleotide linkages, and/or one or more (e.g., about 1, 2, 3, 4, 5, 6, 7, 8, 9, 10 or more) 2'-deoxy, 2'-O-methyl, 2'-deoxy-2'-fluoro, 2'-O-trifluoromethyl, 2'-O-ethyl-trifluoromethoxy, 2'-O-difluoromethoxy-ethoxy, 4'-thio and/or one or more (e.g., about 1, 2, 3, 4, 5, 6, 7, 8, 9, 10 or more) universal base modified nucleotides, and optionally a terminal cap molecule at the 3'-end, the 5'-end, or both of the 3'-and 5'-ends of the antisense strand. In another embodiment, one or more, for example about 1, 2, 3, 4, 5, 6, 7, 8, 9, 10 or more pyrimidine nucleotides of the sense and/or antisense siNA strand are chemically-modified with 2'-deoxy, 2'-O-methyl, 2'-O-trifluoromethyl, 2'-O-ethyl-trifluoromethoxy, 2'-O-difluoromethoxy-ethoxy, 4'-thio and/or 2'-deoxy-2'-fluoro nucleotides, with or without about 1 to about 5, for example about 1, 2, 3, 4, 5 or more phosphorothioate internucleotide linkages and/or a terminal cap molecule at the 3'-end, the 5'-end, or both of the 3'- and 5'-ends, being present in the same or different strand.

In one embodiment, the invention features a chemically-modified short interfering nucleic acid (siNA) molecule having about 1 to about 5 or more (specifically about 1, 2, 3, 4, 5 or more) phosphorothioate internucleotide linkages in each strand of the siNA molecule.

In another embodiment, the invention features a siNA molecule comprising 2'-5' internucleotide linkages. The 2'-5' internucleotide linkage(s) can be at the 3'-end, the 5'-end, or both of the 3'- and 5'-ends of one or both siNA sequence strands. In addition, the 2'-5' internucleotide linkage(s) can be present at various other positions within one or both siNA sequence strands, for example, about 1, 2, 3, 4, 5, 6, 7, 8, 9, 10, or more including every internucleotide linkage of a pyrimidine nucleotide in one or both strands of the siNA molecule can comprise a 2'-5' internucleotide linkage, or about 1, 2, 3, 4, 5, 6, 7, 8, 9, 10, or more including every internucleotide linkage of a purine nucleotide in one or both strands of the siNA molecule can comprise a 2'-5' internucleotide linkage.

In another embodiment, a chemically-modified siNA molecule of the invention comprises a duplex having two strands, one or both of which can be chemically-modified, wherein each strand is independently about 15 to about 30 (e.g., about 15, 16, 17, 18, 19, 20, 21, 22, 23, 24, 25, 26, 27, 28, 29, or 30) nucleotides in length, wherein the duplex has about 15 to about 30 (e.g., about 15, 16, 17, 18, 19, 20, 21, 22, 23, 24, 25, 26, 27, 28, 29, or 30) base pairs, and wherein the chemical modification comprises a structure having any of Formulae I-VII. For example, an exemplary chemically-modified siNA molecule of the invention comprises a duplex having two strands, one or both of which can be chemically-modified with a chemical modification having any of Formulae I-VII or any combination thereof, wherein each strand consists of about 21 nucleotides, each having a 2-nucleotide 3'-terminal nucleotide overhang, and wherein the duplex has about 19 base pairs. In another embodiment, a siNA molecule of the invention comprises a single stranded hairpin structure, wherein the siNA is about 36 to about 70 (e.g., about 36, 40, 45, 50, 55, 60, 65, or 70) nucleotides in length having about 15 to about 30 (e.g., about 15, 16, 17, 18, 19, 20, 21, 22, 23, 24, 25, 26, 27, 28, 29, or 30) base pairs, and wherein the siNA can include a chemical modification comprising a structure having any of Formulae I-VII or any combination thereof. For example, an exemplary chemically-modified siNA molecule of the invention comprises a linear oligonucleotide having about 42 to about 50 (e.g., about 42, 43, 44, 45, 46, 47, 48, 49, or 50) nucleotides that is chemically-modified with a chemical modification having any of Formulae I-VII or any combination thereof, wherein the linear oligonucleotide forms a hairpin structure having about 19 to about 21 (e.g., 19, 20, or 21) base pairs and a 2-nucleotide 3'-terminal nucleotide overhang. In another embodiment, a linear hairpin siNA molecule of the invention contains a stem loop motif, wherein the loop portion of the siNA molecule is biodegradable. For example, a linear hairpin siNA molecule of the invention is designed such that degradation of the loop portion of the siNA molecule in vivo can generate a double-stranded siNA molecule with 3'-terminal overhangs, such as 3'-terminal nucleotide overhangs comprising about 2 nucleotides.

In another embodiment, a siNA molecule of the invention comprises a hairpin structure, wherein the siNA is about 25 to about 50 (e.g., about 25, 26, 27, 28, 29, 30, 31, 32, 33, 34, 35, 36, 37, 38, 39, 40, 41, 42, 43, 44, 45, 46, 47, 48, 49, or 50) nucleotides in length having about 3 to about 25 (e.g., about 3, 4, 5, 6, 7, 8, 9, 10, 11, 12, 13, 14, 15, 16, 17, 18, 19, 20, 21, 22, 23, 24, or 25) base pairs, and wherein the siNA can include one or more chemical modifications comprising a structure having any of Formulae I-VII or any combination thereof. For example, an exemplary chemically-modified siNA molecule of the invention comprises a linear oligonucleotide having about 25 to about 35 (e.g., about 25, 26, 27, 28, 29, 30, 31, 32, 33, 34, or 35) nucleotides that is chemically-modified with one or more chemical modifications having any of Formulae I-VII or any combination thereof, wherein the linear oligonucleotide forms a hairpin structure having about 3 to about 25 (e.g., about 3, 4, 5, 6, 7, 8, 9, 10, 11, 12, 13, 14, 15, 16, 17, 18, 19, 20, 21, 22, 23, 24, or 25) base pairs and a 5'-terminal phosphate group that can be chemically modified as described herein (for example a 5'-terminal phosphate group having Formula IV). In another embodiment, a linear hairpin siNA molecule of the invention contains a stem loop motif, wherein the loop portion of the siNA molecule is biodegradable. In one embodiment, a linear hairpin siNA molecule of the invention comprises a loop portion comprising a non-nucleotide linker.

In another embodiment, a siNA molecule of the invention comprises an asymmetric hairpin structure, wherein the siNA is about 25 to about 50 (e.g., about 25, 26, 27, 28, 29, 30, 31, 32, 33, 34, 35, 36, 37, 38, 39, 40, 41, 42, 43, 44, 45, 46, 47, 48, 49, or 50) nucleotides in length having about 3 to about 25 (e.g., about 3, 4, 5, 6, 7, 8, 9, 10, 11, 12, 13, 14, 15, 16, 17, 18, 19, 20, 21, 22, 23, 24, or 25) base pairs, and wherein the siNA can include one or more chemical modifications comprising a structure having any of Formulae I-VII or any combination thereof. For example, an exemplary chemically-modified siNA molecule of the invention comprises a linear oligonucleotide having about 25 to about 35 (e.g., about 25, 26, 27, 28, 29, 30, 31, 32, 33, 34, or 35) nucleotides that is chemically-modified with one or more chemical modifications having any of Formulae I-VII or any combination thereof, wherein the linear oligonucleotide forms an asymmetric hairpin structure having about 3 to about 25 (e.g., about 3, 4, 5, 6, 7, 8, 9, 10, 11, 12, 13, 14, 15, 16, 17, 18, 19, 20, 21, 22, 23, 24, or 25) base pairs and a 5'-terminal phosphate group that can be chemically modified as described herein (for example a 5'-terminal phosphate group having Formula IV). In one embodiment, an asymmetric hairpin siNA molecule of the invention contains a stem loop motif, wherein the loop portion of the siNA molecule is biodegradable. In another embodiment, an asymmetric hairpin siNA molecule of the invention comprises a loop portion comprising a non-nucleotide linker.

In another embodiment, a siNA molecule of the invention comprises an asymmetric double stranded structure having separate polynucleotide strands comprising sense and antisense regions, wherein the antisense region is about 15 to about 30 (e.g., about 15, 16, 17, 18, 19, 20, 21, 22, 23, 24, 25, 26, 27, 28, 29, or 30) nucleotides in length, wherein the sense region is about 3 to about 25 (e.g., about 3, 4, 5, 6, 7, 8, 9, 10, 11, 12, 13, 14, 15, 16, 17, 18, 19, 20, 21, 22, 23, 24, or 25) nucleotides in length, wherein the sense region and the antisense region have at least 3 complementary nucleotides, and wherein the siNA can include one or more chemical modifications comprising a structure having any of Formulae I-VII or any combination thereof. For example, an exemplary chemically-modified siNA molecule of the invention comprises an asymmetric double stranded structure having separate polynucleotide strands comprising sense and antisense regions, wherein the antisense region is about 18 to about 23 (e.g., about 18, 19, 20, 21, 22, or 23) nucleotides in length and wherein the sense region is about 3 to about 15 (e.g., about 3, 4, 5, 6, 7, 8, 9, 10, 11, 12, 13, 14, or 15) nucleotides in length, wherein the sense region the antisense region have at least 3 complementary nucleotides, and wherein the siNA can include one or more chemical modifications comprising a structure having any of Formulae I-VII or any combination thereof. In another embodiment, the asymmetric double stranded siNA molecule can also have a 5'-terminal phosphate group that can be chemically modified as described herein (for example a 5'-terminal phosphate group having Formula IV).

In another embodiment, a siNA molecule of the invention comprises a circular nucleic acid molecule, wherein the siNA is about 38 to about 70 (e.g., about 38, 40, 45, 50, 55, 60, 65, or 70) nucleotides in length having about 15 to about 30 (e.g., about 15, 16, 17, 18, 19, 20, 21, 22, 23, 24, 25, 26, 27, 28, 29, or 30) base pairs, and wherein the siNA can include a chemical modification, which comprises a structure having any of Formulae I-VII or any combination thereof. For example, an exemplary chemically-modified siNA molecule of the invention comprises a circular oligonucleotide having about 42 to about 50 (e.g., about 42, 43, 44, 45, 46, 47, 48, 49, or 50) nucleotides that is chemically-modified with a chemical modification having any of Formulae I-VII or any combination thereof, wherein the circular oligonucleotide forms a dumbbell shaped structure having about 19 base pairs and 2 loops.

In another embodiment, a circular siNA molecule of the invention contains two loop motifs, wherein one or both loop portions of the siNA molecule is biodegradable. For example, a circular siNA molecule of the invention is designed such that degradation of the loop portions of the siNA molecule in vivo can generate a double-stranded siNA molecule with 3'-terminal overhangs, such as 3'-terminal nucleotide overhangs comprising about 2 nucleotides.

In one embodiment, a siNA molecule of the invention comprises at least one (e.g., about 1, 2, 3, 4, 5, 6, 7, 8, 9, 10, or more) abasic moiety, for example a compound having Formula V:

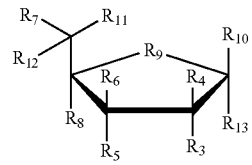

wherein each R3, R4, R5, R6, R7, R8, R10, R11, R12, and R13 is independently H, OH, alkyl, substituted alkyl, alkaryl or aralkyl, F, Cl, Br, CN, CF3, OCF3, OCN, O-alkyl, S-alkyl, N-alkyl, O-alkenyl, S-alkenyl, N-alkenyl, SO-alkyl, alkyl-SH, alkyl-OH, O-alkyl-OH, O-alkyl-SH, S-alkyl-OH, S-alkyl-SH, alkyl-S-alkyl, alkyl-O-alkyl, ONO2, NO2, N3, NH2, aminoalkyl, aminoacid, aminoacyl, ONH2, O-aminoalkyl, O-aminoacid, O-aminoacyl, heterocycloalkyl, heterocycloalkaryl, aminoalkylamino, polyalklyamino, substituted silyl, or a group having any of Formula I, II, III, IV, V, VI and/or VII, any of which can be included in the structure of the siNA molecule or serve as a point of attachment to the siNA molecule; R9 is O, S, CH2, S=O, CHF, or CF2. In one embodiment, R3 and/or R7 comprises a conjugate moiety and a linker (e.g., a nucleotide or non-nucleotide linker as described herein or otherwise known in the art). Non-limiting examples of conjugate moieties include ligands for cellular receptors, such as peptides derived from naturally occurring protein ligands; protein localization sequences, including cellular ZIP code sequences; antibodies; nucleic acid aptamers; vitamins and other co-factors, such as folate and N-acetylgalactosamine; polymers, such as polyethyleneglycol (PEG); phospholipids; cholesterol; steroids, and polyamines, such as PEI, spermine or spermidine.

In one embodiment, a siNA molecule of the invention comprises at least one (e.g., about 1, 2, 3, 4, 5, 6, 7, 8, 9, 10, or more) inverted abasic moiety, for example a compound having Formula VI:

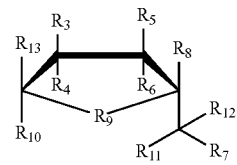

wherein each R3, R4, R5, R6, R7, R8, R10, R11, R12, and R13 is independently H, OH, alkyl, substituted alkyl, alkaryl or aralkyl, F, Cl, Br, CN, CF3, OCF3, OCN, O-alkyl, S-alkyl, N-alkyl, O-alkenyl, S-alkenyl, N-alkenyl, SO-alkyl, alkyl- SH, alkyl-OH, O-alkyl-OH, O-alkyl-SH, S-alkyl-OH, S-alkyl-SH, alkyl-S-alkyl, alkyl-O-alkyl, ONO2, NO2, N3, NH2, aminoalkyl, aminoacid, aminoacyl, ONH2, O-aminoalkyl, O-aminoacid, O-aminoacyl, heterocycloalkyl, heterocycloalkaryl, aminoalkylamino, polyalklylamino, substituted silyl, or a group having any of Formula I, II, III, IV, V, VI and/or VII, any of which can be included in the structure of the siNA molecule or serve as a point of attachment to the siNA molecule; R9 is O, S, CH2, S=O, CHF, or CF2, and either R2, R3, R8 or R13 serve as points of attachment to the siNA molecule of the invention. In one embodiment, R3 and/or R7 comprises a conjugate moiety and a linker (e.g., a nucleotide or non-nucleotide linker as described herein or otherwise known in the art). Non-limiting examples of conjugate moieties include ligands for cellular receptors, such as peptides derived from naturally occurring protein ligands; protein localization sequences, including cellular ZIP code sequences; antibodies; nucleic acid aptamers; vitamins and other co-factors, such as folate and N-acetylgalactosamine; polymers, such as polyethyleneglycol (PEG); phospholipids; cholesterol; steroids, and polyamines, such as PEI, spermine or spermidine.

In another embodiment, a siNA molecule of the invention comprises at least one (e.g., about 1, 2, 3, 4, 5, 6, 7, 8, 9, 10, or more) substituted polyalkyl moieties, for example a compound having Formula VII:

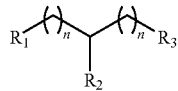

wherein each n is independently an integer from 1 to 12, each R1, R2 and R3 is independently H, OH, alkyl, substituted alkyl, alkaryl or aralkyl, F, Cl, Br, CN, CF3, OCF3, OCN, O-alkyl, S-alkyl, N-alkyl, O-alkenyl, S-alkenyl, N-alkenyl, SO-alkyl, alkyl-SH, alkyl-OH, O-alkyl-OH, O-alkyl-SH, S-alkyl-OH, S-alkyl-SH, alkyl-S-alkyl, alkyl-O-alkyl, ONO2, NO2, N3, NH2, aminoalkyl, aminoacid, aminoacyl, ONH2, O-aminoalkyl, O-aminoacid, O-aminoacyl, heterocycloalkyl, heterocycloalkaryl, aminoalkylamino, polyalklylamino, substituted silyl, or a group having any of Formula I, II, III, IV, V, VI and/or VII, any of which can be included in the structure of the siNA molecule or serve as a point of attachment to the siNA molecule. In one embodiment, R3 and/or R1 comprises a conjugate moiety and a linker (e.g., a nucleotide or non-nucleotide linker as described herein or otherwise known in the art). Non-limiting examples of conjugate moieties include ligands for cellular receptors, such as peptides derived from naturally occurring protein ligands; protein localization sequences, including cellular ZIP code sequences; antibodies; nucleic acid aptamers; vitamins and other co-factors, such as folate and N-acetylgalactosamine; polymers, such as polyethyleneglycol (PEG); phospholipids; cholesterol; steroids, and polyamines, such as PEI, spermine or spermidine.

By "ZIP code" sequences is meant, any peptide or protein sequence that is involved in cellular topogenic signaling mediated transport (see for example Ray et al., 2004, *Science*, 306(1501): 1505).

Each nucleotide within the double stranded siNA molecule can independently have a chemical modification comprising the structure of any of Formulae I-VIII. Thus, in one embodiment, one or more nucleotide positions of a siNA molecule of the invention comprises a chemical modification having structure of any of Formulae I-VII or any other modification herein. In one embodiment, each nucleotide position of a siNA molecule of the invention comprises a chemical modification having structure of any of Formulae I-VII or any other modification herein.

In one embodiment, one or more nucleotide positions of one or both strands of a double stranded siNA molecule of the invention comprises a chemical modification having structure of any of Formulae I-VII or any other modification herein. In one embodiment, each nucleotide position of one or both strands of a double stranded siNA molecule of the invention comprises a chemical modification having structure of any of Formulae I-VII or any other modification herein.

In another embodiment, the invention features a compound having Formula VII, wherein R1 and R2 are hydroxyl (OH) groups, n=1, and R3 comprises 0 and is the point of attachment to the 3'-end, the 5'-end, or both of the 3' and 5'-ends of one or both strands of a double-stranded siNA molecule of the invention or to a single-stranded siNA molecule of the invention. This modification is referred to herein as "glyceryl" (for example modification 6 in FIG. 10).

In another embodiment, a chemically modified nucleoside or non-nucleoside (e.g. a moiety having any of Formula V, VI or VII) of the invention is at the 3'-end, the 5'-end, or both of the 3' and 5'-ends of a siNA molecule of the invention. For example, chemically modified nucleoside or non-nucleoside (e.g., a moiety having Formula V, VI or VII) can be present at the 3'-end, the 5'-end, or both of the 3' and 5'-ends of the antisense strand, the sense strand, or both antisense and sense strands of the siNA molecule. In one embodiment, the chemically modified nucleoside or non-nucleoside (e.g., a moiety having Formula V, VI or VII) is present at the 5'-end and 3'-end of the sense strand and the 3'-end of the antisense strand of a double stranded siNA molecule of the invention. In one embodiment, the chemically modified nucleoside or non-nucleoside (e.g., a moiety having Formula V, VI or VII) is present at the terminal position of the 5'-end and 3'-end of the sense strand and the 3'-end of the antisense strand of a double stranded siNA molecule of the invention. In one embodiment, the chemically modified nucleoside or non-nucleoside (e.g., a moiety having Formula V, VI or VII) is present at the two terminal positions of the 5'-end and 3'-end of the sense strand and the 3'-end of the antisense strand of a double stranded siNA molecule of the invention. In one embodiment, the chemically modified nucleoside or non-nucleoside (e.g., a moiety having Formula V, VI or VII) is present at the penultimate position of the 5'-end and 3'-end of the sense strand and the 3'-end of the antisense strand of a double stranded siNA molecule of the invention. In addition, a moiety having Formula VII can be present at the 3'-end or the 5'-end of a hairpin siNA molecule as described herein.

In another embodiment, a siNA molecule of the invention comprises an abasic residue having Formula V or VI, wherein the abasic residue having Formula VI or VI is connected to the siNA construct in a 3'-3',3'-2',2'-3', or 5'-5' configuration, such as at the 3'-end, the 5'-end, or both of the 3' and 5'-ends of one or both siNA strands.

In one embodiment, a siNA molecule of the invention comprises one or more (e.g., about 1, 2, 3, 4, 5, 6, 7, 8, 9, 10, or more) locked nucleic acid (LNA) nucleotides, for example, at the 5'-end, the 3'-end, both of the 5' and 3'-ends, or any combination thereof, of the siNA molecule.

In one embodiment, a siNA molecule of the invention comprises one or more (e.g., about 1, 2, 3, 4, 5, 6, 7, 8, 9, 10, or more) 4'-thio nucleotides, for example, at the 5'-end, the 3'-end, both of the 5' and 3'-ends, or any combination thereof, of the siNA molecule.

In another embodiment, a siNA molecule of the invention comprises one or more (e.g., about 1, 2, 3, 4, 5, 6, 7, 8, 9, 10, or more) acyclic nucleotides, for example, at the 5'-end, the 3'-end, both of the 5' and 3'-ends, or any combination thereof, of the siNA molecule.

In one embodiment, a chemically-modified short interfering nucleic acid (siNA) molecule of the invention comprises a sense strand or sense region having one or more (e.g., 1, 2, 3, 4, 5, 6, 7, 8, 9, 10, 11, 12, 13, 14 15, 16, 17, 18, 19, 20, 21, 22, 23, 24, 25, 26, 27, 28, 29, 30 or more) 2'-O-alkyl (e.g. 2'-O-methyl), 2'-deoxy-2'-fluoro, 2'-deoxy, or abasic chemical modifications or any combination thereof.

In one embodiment, a chemically-modified short interfering nucleic acid (siNA) molecule of the invention comprises an antisense strand or antisense region having one or more (e.g., 1, 2, 3, 4, 5, 6, 7, 8, 9, 10, 11, 12, 13, 14 15, 16, 17, 18, 19, 20, 21, 22, 23, 24, 25, 26, 27, 28, 29, 30 or more) 2'-O-alkyl (e.g. 2'-O-methyl), 2'-deoxy-2'-fluoro, 2'-deoxy, or abasic chemical modifications or any combination thereof.

In one embodiment, a chemically-modified short interfering nucleic acid (siNA) molecule of the invention comprises a sense strand or sense region and an antisense strand or antisense region, each having one or more (e.g., 1, 2, 3, 4, 5, 6, 7, 8, 9, 10, 11, 12, 13, 14 15, 16, 17, 18, 19, 20, 21, 22, 23, 24, 25, 26, 27, 28, 29, 30 or more) 2'-O-alkyl (e.g. 2'-O-methyl), 2'-deoxy-2'-fluoro, 2'-deoxy, or abasic chemical modifications or any combination thereof.

In one embodiment, the invention features a chemically-modified short interfering nucleic acid (siNA) molecule of the invention comprising a sense region, wherein any (e.g., one or more or all) pyrimidine nucleotides present in the sense region are 2'-deoxy-2'-fluoro pyrimidine nucleotides (e.g., wherein all pyrimidine nucleotides are 2'-deoxy-2'-fluoro pyrimidine nucleotides or alternately a plurality of pyrimidine nucleotides are 2'-deoxy-2'-fluoro pyrimidine nucleotides).

In one embodiment, the invention features a chemically-modified short interfering nucleic acid (siNA) molecule of the invention comprising an antisense region, wherein any (e.g., one or more or all) pyrimidine nucleotides present in the antisense region are 2'-deoxy-2'-fluoro pyrimidine nucleotides (e.g., wherein all pyrimidine nucleotides are 2'-deoxy-2'-fluoro pyrimidine nucleotides or alternately a plurality of pyrimidine nucleotides are 2'-deoxy-2'-fluoro pyrimidine nucleotides).

In one embodiment, the invention features a chemically-modified short interfering nucleic acid (siNA) molecule of the invention comprising a sense region and an antisense region, wherein any (e.g., one or more or all) pyrimidine nucleotides present in the sense region and the antisense region are 2'-deoxy-2'-fluoro pyrimidine nucleotides (e.g., wherein all pyrimidine nucleotides are 2'-deoxy-2'-fluoro pyrimidine nucleotides or alternately a plurality of pyrimidine nucleotides are 2'-deoxy-2'-fluoro pyrimidine nucleotides).

In one embodiment, the invention features a chemically-modified short interfering nucleic acid (siNA) molecule of the invention comprising a sense region, wherein any (e.g., one or more or all) purine nucleotides present in the sense region are 2'-deoxy purine nucleotides (e.g., wherein all purine nucleotides are 2'-deoxy purine nucleotides or alternately a plurality of purine nucleotides are 2'-deoxy purine nucleotides).

In one embodiment, the invention features a chemically-modified short interfering nucleic acid (siNA) molecule of the invention comprising an antisense region, wherein any (e.g., one or more or all) purine nucleotides present in the antisense region are 2'-O-methyl purine nucleotides (e.g., wherein all purine nucleotides are 2'-O-methyl purine nucleotides or alternately a plurality of pyrimidine nucleotides are 2'-O-methyl purine nucleotides).

In one embodiment, the invention features a chemically-modified short interfering nucleic acid (siNA) molecule of the invention comprising a sense region, wherein any (e.g., one or more or all) pyrimidine nucleotides present in the sense region are 2'-deoxy-2'-fluoro pyrimidine nucleotides (e.g., wherein all pyrimidine nucleotides are 2'-deoxy-2'-fluoro pyrimidine nucleotides or alternately a plurality of pyrimidine nucleotides are 2'-deoxy-2'-fluoro pyrimidine nucleotides), and wherein any (e.g., one or more or all) purine nucleotides present in the sense region are 2'-deoxy purine nucleotides (e.g., wherein all purine nucleotides are 2'-deoxy purine nucleotides or alternately a plurality of purine nucleotides are 2'-deoxy purine nucleotides).

In one embodiment, the invention features a chemically-modified short interfering nucleic acid (siNA) molecule of the invention comprising a sense region, wherein any (e.g., one or more or all) pyrimidine nucleotides present in the sense region are 2'-deoxy-2'-fluoro, 4'-thio, 2'-O-trifluoromethyl, 2'-O-ethyl-trifluoromethoxy, or 2'-O-difluoromethoxy-ethoxy pyrimidine nucleotides (e.g., wherein all pyrimidine nucleotides are 2'-deoxy-2'-fluoro, 4'-thio, 2'-O-trifluoromethyl, 2'-O-ethyl-trifluoromethoxy, or 2'-O-difluoromethoxy-ethoxy pyrimidine nucleotides or alternately a plurality of pyrimidine nucleotides are 2'-deoxy-2'-fluoro, 4'-thio, 2'-O-trifluoromethyl, 2'-O-ethyl-trifluoromethoxy, or 2'-O-difluoromethoxy-ethoxy pyrimidine nucleotides), and wherein any (e.g., one or more or all) purine nucleotides present in the sense region are 2'-deoxy purine nucleotides (e.g., wherein all purine nucleotides are 2'-deoxy purine nucleotides or alternately a plurality of purine nucleotides are 2'-deoxy purine nucleotides), wherein any nucleotides comprising a 3'-terminal nucleotide overhang that are present in said sense region are 2'-deoxy nucleotides.

In one embodiment, the invention features a chemically-modified short interfering nucleic acid (siNA) molecule of the invention comprising a sense region, wherein any (e.g., one or more or all) pyrimidine nucleotides present in the sense region are 2'-deoxy-2'-fluoro, 4'-thio, 2'-O-trifluoromethyl, 2'-O-ethyl-trifluoromethoxy, or 2'-O-difluoromethoxy-ethoxy pyrimidine nucleotides (e.g., wherein all pyrimidine nucleotides are 2'-deoxy-2'-fluoro, 4'-thio, 2'-O-trifluoromethyl, 2'-O-ethyl-trifluoromethoxy, or 2'-O-difluoromethoxy-ethoxy pyrimidine nucleotides or alternately a plurality of pyrimidine nucleotides are 2'-deoxy-2'-fluoro, 4'-thio, 2'-O-trifluoromethyl, 2'-O-ethyl-trifluoromethoxy, or 2'-O-difluoromethoxy-ethoxy pyrimidine nucleotides), and wherein any (e.g., one or more or all) purine nucleotides present in the sense region are 2'-O-methyl purine nucleotides (e.g., wherein all purine nucleotides are 2'-O-methyl, 4'-thio, 2'-O-trifluoromethyl, 2'-O-ethyl-trifluoromethoxy, or 2'-O-difluoromethoxy-ethoxy purine nucleotides or alternately a plurality of purine nucleotides are 2'-O-methyl, 4'-thio, 2'-O-trifluoromethyl, 2'-O-ethyl-trifluoromethoxy, or 2'-O-difluoromethoxy-ethoxy purine nucleotides).

In one embodiment, the invention features a chemically-modified short interfering nucleic acid (siNA) molecule of the invention comprising a sense region, wherein any (e.g., one or more or all) pyrimidine nucleotides present in the sense region are 2'-deoxy-2'-fluoro, 4'-thio, 2'-O-trifluoromethyl, 2'-O-ethyl-trifluoromethoxy, or 2'-O-difluoromethoxy-ethoxy pyrimidine nucleotides (e.g., wherein all pyrimidine nucleotides are 2'-deoxy-2'-fluoro, 4'-thio, 2'-O-trifluoromethyl, 2'-O-ethyl-trifluoromethoxy, or 2'-O-difluoromethoxy-ethoxy pyrimidine nucleotides or alternately a plurality of pyrimidine nucleotides are 2'-deoxy-2'-fluoro, 4'-thio, 2'-O-trifluoromethyl, 2'-O-ethyl-trifluoromethoxy, or 2'-O-difluoromethoxy-ethoxy pyrimidine nucleotides), wherein any (e.g., one or more or all) purine nucleotides present in the sense region are 2'-O-methyl, 4'-thio, 2'-O-trifluoromethyl, 2'-O-ethyl-trifluoromethoxy, or 2'-O-difluoromethoxy-ethoxy purine nucleotides (e.g., wherein all purine nucleotides are 2'-O-methyl, 4'-thio, 2'-O-trifluoromethyl, 2'-O-ethyl-trifluoromethoxy, or 2'-O-difluoromethoxy-ethoxy purine nucleotides or alternately a plurality of purine nucleotides are 2'-O-methyl, 4'-thio, 2'-O-trifluoromethyl, 2'-O-ethyl-trifluoromethoxy, or 2'-O-difluoromethoxy-ethoxy purine nucleotides), and wherein any nucleotides comprising a 3'-terminal nucleotide overhang that are present in said sense region are 2'-deoxy nucleotides.

In one embodiment, the invention features a chemically-modified short interfering nucleic acid (siNA) molecule of the invention comprising an antisense region, wherein any (e.g., one or more or all) pyrimidine nucleotides present in the antisense region are 2'-deoxy-2'-fluoro, 4'-thio, 2'-O-trifluoromethyl, 2'-O-ethyl-trifluoromethoxy, or 2'-O-difluoromethoxy-ethoxy pyrimidine nucleotides (e.g., wherein all pyrimidine nucleotides are 2'-deoxy-2'-fluoro, 4'-thio, 2'-O-trifluoromethyl, 2'-O-ethyl-trifluoromethoxy, or 2'-O-difluoromethoxy-ethoxy pyrimidine nucleotides or alternately a plurality of pyrimidine nucleotides are 2'-deoxy-2'-fluoro, 4'-thio, 2'-O-trifluoromethyl, 2'-O-ethyl-trifluoromethoxy, or 2'-O-difluoromethoxy-ethoxy pyrimidine nucleotides), and wherein any (e.g., one or more or all) purine nucleotides present in the antisense region are 2'-O-methyl, 4'-thio, 2'-O-trifluoromethyl, 2'-O-ethyl-trifluoromethoxy, or 2'-O-difluoromethoxy-ethoxy purine nucleotides (e.g., wherein all purine nucleotides are 2'-O-methyl, 4'-thio, 2'-O-trifluoromethyl, 2'-O-ethyl-trifluoromethoxy, or 2'-O-difluoromethoxy-ethoxy purine nucleotides or alternately a plurality of purine nucleotides are 2'-O-methyl, 4'-thio, 2'-O-trifluoromethyl, 2'-O-ethyl-trifluoromethoxy, or 2'-O-difluoromethoxy-ethoxy purine nucleotides).

In one embodiment, the invention features a chemically-modified short interfering nucleic acid (siNA) molecule of the invention comprising an antisense region, wherein any (e.g., one or more or all) pyrimidine nucleotides present in the antisense region are 2'-deoxy-2'-fluoro, 4'-thio, 2'-O-trifluoromethyl, 2'-O-ethyl-trifluoromethoxy, or 2'-O-difluoromethoxy-ethoxy pyrimidine nucleotides (e.g., wherein all pyrimidine nucleotides are 2'-deoxy-2'-fluoro, 4'-thio, 2'-O-trifluoromethyl, 2'-O-ethyl-trifluoromethoxy, or 2'-O-difluoromethoxy-ethoxy pyrimidine nucleotides or alternately a plurality of pyrimidine nucleotides are 2'-deoxy-2'-fluoro, 4'-thio, 2'-O-trifluoromethyl, 2'-O-ethyl-trifluoromethoxy, or 2'-O-difluoromethoxy-ethoxy pyrimidine nucleotides), wherein any (e.g., one or more or all) purine nucleotides present in the antisense region are 2'-O-methyl, 4'-thio, 2'-O-trifluoromethyl, 2'-O-ethyl-trifluoromethoxy, or 2'-O-difluoromethoxy-ethoxy purine nucleotides (e.g., wherein all purine nucleotides are 2'-O-methyl, 4'-thio, 2'-O-trifluoromethyl, 2'-O-ethyl-trifluoromethoxy, or 2'-O-difluoromethoxy-ethoxy purine nucleotides or alternately a plurality of purine nucleotides are 2'-O-methyl, 4'-thio, 2'-O-trifluoromethyl, 2'-O-ethyl-trifluoromethoxy, or 2'-O-difluoromethoxy-ethoxy purine nucleotides), and wherein any nucleotides comprising a 3'-terminal nucleotide overhang that are present in said antisense region are 2'-deoxy nucleotides.

In one embodiment, the invention features a chemically-modified short interfering nucleic acid (siNA) molecule of the invention comprising an antisense region, wherein any (e.g., one or more or all) pyrimidine nucleotides present in the antisense region are 2'-deoxy-2'-fluoro, 4'-thio, 2'-O-trifluoromethyl, 2'-O-ethyl-trifluoromethoxy, or 2'-O-difluoromethoxy-ethoxy pyrimidine nucleotides (e.g., wherein all pyrimidine nucleotides are 2'-deoxy-2'-fluoro, 4'-thio, 2'-O-trifluoromethyl, 2'-O-ethyl-trifluoromethoxy, or 2'-O-difluoromethoxy-ethoxy pyrimidine nucleotides or alternately a plurality of pyrimidine nucleotides are 2'-deoxy-2'-fluoro, 4'-thio, 2'-O-trifluoromethyl, 2'-O-ethyl-trifluoromethoxy, or 2'-O-difluoromethoxy-ethoxy pyrimidine nucleotides), and wherein any (e.g., one or more or all) purine nucleotides present in the antisense region are 2'-deoxy purine nucleotides (e.g., wherein all purine nucleotides are 2'-deoxy purine nucleotides or alternately a plurality of purine nucleotides are 2'-deoxy purine nucleotides).

In one embodiment, the invention features a chemically-modified short interfering nucleic acid (siNA) molecule of the invention comprising an antisense region, wherein any (e.g., one or more or all) pyrimidine nucleotides present in the antisense region are 2'-deoxy-2'-fluoro, 4'-thio, 2'-O-trifluoromethyl, 2'-O-ethyl-trifluoromethoxy, or 2'-O-difluoromethoxy-ethoxy pyrimidine nucleotides (e.g., wherein all pyrimidine nucleotides are 2'-deoxy-2'-fluoro, 4'-thio, 2'-O-trifluoromethyl, 2'-O-ethyl-trifluoromethoxy, or 2'-O-difluoromethoxy-ethoxy pyrimidine nucleotides or alternately a plurality of pyrimidine nucleotides are 2'-deoxy-2'-fluoro, 4'-thio, 2'-O-trifluoromethyl, 2'-O-ethyl-trifluoromethoxy, or 2'-O-difluoromethoxy-ethoxy pyrimidine nucleotides), and wherein any (e.g., one or more or all) purine nucleotides present in the antisense region are 2'-O-methyl, 4'-thio, 2'-O-trifluoromethyl, 2'-O-ethyl-trifluoromethoxy, or 2'-O-difluoromethoxy-ethoxy purine nucleotides (e.g., wherein all purine nucleotides are 2'-O-methyl, 4'-thio, 2'-O-trifluoromethyl, 2'-O-ethyl-trifluoromethoxy, or 2'-O-difluoromethoxy-ethoxy purine nucleotides or alternately a plurality of purine nucleotides are 2'-O-methyl, 4'-thio, 2'-O-trifluoromethyl, 2'-O-ethyl-trifluoromethoxy, or 2'-O-difluoromethoxy-ethoxy purine nucleotides).

In one embodiment, the invention features a chemically-modified short interfering nucleic acid (siNA) molecule of the invention capable of mediating RNA interference (RNAi) inside a cell or reconstituted in vitro system comprising a sense region, wherein one or more pyrimidine nucleotides present in the sense region are 2'-deoxy-2'-fluoro, 4'-thio, 2'-O-trifluoromethyl, 2'-O-ethyl-trifluoromethoxy, or 2'-O-difluoromethoxy-ethoxy pyrimidine nucleotides (e.g., wherein all pyrimidine nucleotides are 2'-deoxy-2'-fluoro, 4'-thio, 2'-O-trifluoromethyl, 2'-O-ethyl-trifluoromethoxy, or 2'-O-difluoromethoxy-ethoxy pyrimidine nucleotides or alternately a plurality of pyrimidine nucleotides are 2'-deoxy-2'-fluoro, 4'-thio, 2'-O-trifluoromethyl, 2'-O-ethyl-trifluoromethoxy, or 2'-O-difluoromethoxy-ethoxy pyrimidine nucleotides), and one or more purine nucleotides present in the sense region are 2'-deoxy purine nucleotides (e.g., wherein all purine nucleotides are 2'-deoxy purine nucleotides or alternately a plurality of purine nucleotides are 2'-deoxy purine nucleotides), and an antisense region, wherein one or more pyrimidine nucleotides present in the antisense region are 2'-deoxy-2'-fluoro, 4'-thio, 2'-O-trifluoromethyl, 2'-O-ethyl-trifluoromethoxy, or 2'-O-difluoromethoxy-ethoxy pyrimidine nucleotides (e.g., wherein all pyrimidine nucleotides are 2'-deoxy-2'-fluoro, 4'-thio, 2'-O-trifluoromethyl, 2'-O-ethyl-trifluoromethoxy, or 2'-O-difluoromethoxy-ethoxy pyrimidine nucleotides or alternately a plurality of pyrimidine nucleotides are 2'-deoxy-2'-fluoro, 4'-thio, 2'-O-trifluoromethyl, 2'-O-ethyl-trifluoromethoxy, or 2'-O-difluoromethoxy-ethoxy pyrimidine nucleotides), and one or more purine nucleotides present in the antisense region are 2'-O-methyl, 4'-thio, 2'-O-trifluoromethyl, 2'-O-ethyl-trifluoromethoxy, or 2'-O-difluoromethoxy-ethoxy purine nucleotides (e.g., wherein all purine nucleotides are 2'-O-methyl, 4'-thio, 2'-O-trifluoromethyl, 2'-O-ethyl-trifluoromethoxy, or 2'-O-difluoromethoxy-ethoxy purine nucleotides or alternately a plurality of purine nucleotides are 2'-O-methyl, 4'-thio, 2'-O-trifluoromethyl, 2'-O-ethyl-trifluoromethoxy, or 2'-O-difluoromethoxy-ethoxy purine nucleotides). The sense region and/or the antisense region can have a terminal cap modification, such as any modification described herein or shown in FIG. 10, that is optionally present at the 3'-end, the 5'-end, or both of the 3' and 5'-ends of the sense and/or antisense sequence. The sense and/or antisense region can optionally further comprise a 3'-terminal nucleotide overhang having about 1 to about 4 (e.g., about 1, 2, 3, or 4) 2'-deoxynucleotides. The overhang nucleotides can further comprise one or more (e.g., about 1, 2, 3, 4 or more) phosphorothioate, phosphonoacetate, and/or thiophosphonoacetate internucleotide linkages. Non-limiting examples of these chemically-modified siNAs are shown in FIGS. 4 and 5 and Table III herein. In any of these described embodiments, the purine nucleotides present in the sense region are alternatively 2'-O-methyl, 4'-thio, 2'-O-trifluoromethyl, 2'-O-ethyl-trifluoromethoxy, or 2'-O-difluoromethoxy-ethoxy purine nucleotides (e.g., wherein all purine nucleotides are 2'-O-methyl, 4'-thio, 2'-O-trifluoromethyl, 2'-O-ethyl-trifluoromethoxy, or 2'-O-difluoromethoxy-ethoxy purine nucleotides or alternately a plurality of purine nucleotides are 2'-O-methyl, 4'-thio, 2'-O-trifluoromethyl, 2'-O-ethyl-trifluoromethoxy, or 2'-O-difluoromethoxy-ethoxy purine nucleotides) and one or more purine nucleotides present in the antisense region are 2'-O-methyl, 4'-thio, 2'-O-trifluoromethyl, 2'-O-ethyl-trifluoromethoxy, or 2'-O-difluoromethoxy-ethoxy purine nucleotides (e.g., wherein all purine nucleotides are 2'-O-methyl, 4'-thio, 2'-O-trifluoromethyl, 2'-O-ethyl-trifluoromethoxy, or 2'-O-difluoromethoxy-ethoxy purine nucleotides or alternatively a plurality of purine nucleotides are 2'-O-methyl, 4'-thio, 2'-O-trifluoromethyl, 2'-O-ethyl-trifluoromethoxy, or 2'-O-difluoromethoxy-ethoxy purine nucleotides). Also, in any of these embodiments, one or more purine nucleotides present in the sense region are alternatively purine ribonucleotides (e.g., wherein all purine nucleotides are purine ribonucleotides or alternately a plurality of purine nucleotides are purine ribonucleotides) and any purine nucleotides present in the antisense region are 2'-O-methyl, 4'-thio, 2'-O-trifluoromethyl, 2'-O-ethyl-trifluoromethoxy, or 2'-O-difluoromethoxy-ethoxy purine nucleotides (e.g., wherein all purine nucleotides are 2'-O-methyl, 4'-thio, 2'-O-trifluoromethyl, 2'-O-ethyl-trifluoromethoxy, or 2'-O-difluoromethoxy-ethoxy purine nucleotides or alternatively a plurality of purine nucleotides are 2'-O-methyl, 4'-thio, 2'-O-trifluoromethyl, 2'-O-ethyl-trifluoromethoxy, or 2'-O-difluoromethoxy-ethoxy purine nucleotides). Additionally, in any of these embodiments, one or more purine nucleotides present in the sense region and/or present in the antisense region are alternatively selected from the group consisting of 2'-deoxy nucleotides, locked nucleic acid (LNA) nucleotides, 2'-methoxyethyl nucleotides, 4'-thionucleotides, 2'-O-trifluoromethyl nucleotides, 2'-O-ethyl-trifluoromethoxy nucleotides, 2'-O-difluoromethoxy-ethoxy nucleotides and 2'-O-methyl nucleotides (e.g., wherein all purine nucleotides are selected from the group consisting of 2'-deoxy nucleotides, locked nucleic acid (LNA) nucleotides, 2'-methoxyethyl nucleotides, 4'-thionucleotides, 2'-O-trifluoromethyl nucleotides, 2'-O-ethyl-trifluoromethoxy nucleotides, 2'-O-difluoromethoxy-ethoxy nucleotides and 2'-O-methyl nucleotides or alternately a plurality of purine nucleotides are selected from the group consisting of 2'-deoxy nucleotides, locked nucleic acid (LNA) nucleotides, 2'-methoxyethyl nucleotides, 4'-thionucleotides, 2'-O-trifluoromethyl nucleotides, 2'-O-ethyl-trifluoromethoxy nucleotides, 2'-O-difluoromethoxy-ethoxy nucleotides and 2'-O-methyl nucleotides).

In another embodiment, any modified nucleotides present in the siNA molecules of the invention, preferably in the antisense strand of the siNA molecules of the invention, but also optionally in the sense and/or both antisense and sense strands, comprise modified nucleotides having properties or characteristics similar to naturally occurring ribonucleotides. For example, the invention features siNA molecules including modified nucleotides having a Northern conformation (e.g., Northern pseudorotation cycle, see for example Saenger, *Principles of Nucleic Acid Structure*, Springer-Verlag ed., 1984) otherwise known as a "ribo-like" or "A-form helix" configuration. As such, chemically modified nucleotides present in the siNA molecules of the invention, preferably in the antisense strand of the siNA molecules of the invention, but also optionally in the sense and/or both antisense and sense strands, are resistant to nuclease degradation while at the same time maintaining the capacity to mediate RNAi. Non-limiting examples of nucleotides having a northern configuration include locked nucleic acid (LNA) nucleotides (e.g., 2'-O, 4'-C-methylene-(D-ribofuranosyl) nucleotides); 2'-methoxyethoxy (MOE) nucleotides; 2'-methyl-thio-ethyl, 2'-deoxy-2'-fluoro nucleotides, 2'-deoxy-2'-chloro nucleotides, 2'-azido nucleotides, 2'-O-trifluoromethyl nucleotides, 2'-O-ethyl-trifluoromethoxy nucleotides, 2'-O-difluoromethoxy-ethoxy nucleotides, 4'-thio nucleotides and 2'-O-methyl nucleotides.

In one embodiment, the sense strand of a double stranded siNA molecule of the invention comprises a terminal cap moiety, (see for example FIG. 10) such as an inverted deoxyabasic moiety, at the 3'-end, 5'-end, or both 3' and 5'-ends of the sense strand.

In one embodiment, the invention features a chemically-modified short interfering nucleic acid molecule (siNA) capable of mediating RNA interference (RNAi) inside a cell or reconstituted in vitro system, wherein the chemical modification comprises a conjugate covalently attached to the chemically-modified siNA molecule. Non-limiting examples of conjugates contemplated by the invention include conjugates and ligands described in Vargeese et al., U.S. Ser. No. 10/427,160, filed Apr. 30, 2003, incorporated by reference herein in its entirety, including the drawings. In another embodiment, the conjugate is covalently attached to the chemically-modified siNA molecule via a biodegradable linker. In one embodiment, the conjugate molecule is attached at the 3'-end of either the sense strand, the antisense strand, or both strands of the chemically-modified siNA molecule. In another embodiment, the conjugate molecule is attached at the 5'-end of either the sense strand, the antisense strand, or both strands of the chemically-modified siNA molecule. In yet another embodiment, the conjugate molecule is attached both the 3'-end and 5'-end of either the sense strand, the antisense strand, or both strands of the chemically-modified siNA molecule, or any combination thereof. In one embodiment, a conjugate molecule of the invention comprises a molecule that facilitates delivery of a chemically-modified siNA molecule into a biological system, such as a cell. In another embodiment, the conjugate molecule attached to the chemically-modified siNA molecule is a ligand for a cellular receptor, such as peptides derived from naturally occurring protein ligands; protein localization sequences, including cellular ZIP code sequences; antibodies; nucleic acid aptamers; vitamins and other co-factors, such as folate and N-acetylgalactosamine; polymers, such as polyethyleneglycol (PEG); phospholipids; cholesterol; steroids, and polyamines, such as PEI, spermine or spermidine. Examples of specific conjugate molecules contemplated by the instant invention that can be attached to chemically-modified siNA molecules are described in Vargeese et al., U.S. Ser. No. 10/201,394, filed Jul. 22, 2002 incorporated by reference herein. The type of conjugates used and the extent of conjugation of siNA molecules of the invention can be evaluated for improved pharmacokinetic profiles, bioavailability, and/or stability of siNA constructs while at the same time maintaining the ability of the siNA to mediate RNAi activity. As such, one skilled in the art can screen siNA constructs that are modified with various conjugates to determine whether the siNA conjugate complex possesses improved properties while maintaining the ability to mediate RNAi, for example in animal models as are generally known in the art.

In one embodiment, the invention features a short interfering nucleic acid (siNA) molecule of the invention, wherein the siNA further comprises a nucleotide, non-nucleotide, or mixed nucleotide/non-nucleotide linker that joins the sense region of the siNA to the antisense region of the siNA. In one embodiment, a nucleotide, non-nucleotide, or mixed nucleotide/non-nucleotide linker is used, for example, to attach a conjugate moiety to the siNA. In one embodiment, a nucleotide linker of the invention can be a linker of ≧2 nucleotides in length, for example about 3, 4, 5, 6, 7, 8, 9, or 10 nucleotides in length. In another embodiment, the nucleotide linker can be a nucleic acid aptamer. By "aptamer" or "nucleic acid aptamer" as used herein is meant a nucleic acid molecule that binds specifically to a RSV target molecule wherein the nucleic acid molecule has sequence that comprises a sequence recognized by the RSV target molecule in its natural setting. Alternately, an aptamer can be a nucleic acid molecule that binds to a RSV target molecule where the RSV target molecule does not naturally bind to a nucleic acid. The RSV target molecule can be any molecule of interest. For example, the aptamer can be used to bind to a ligand-binding domain of a protein, thereby preventing interaction of the naturally occurring ligand with the protein. This is a non-limiting example and those in the art will recognize that other embodiments can be readily generated using techniques generally known in the art. (See, for example, Gold et al., 1995, *Annu. Rev. Biochem.*, 64, 763; Brody and Gold, 2000, *J. Biotechnol.*, 74, 5; Sun, 2000, *Curr. Opin. Mol. Ther.*, 2, 100; Kusser, 2000, *J. Biotechnol.*, 74, 27; Hermann and Patel, 2000, *Science*, 287, 820; and Jayasena, 1999, *Clinical Chemistry*, 45, 1628.)

In yet another embodiment, a non-nucleotide linker of the invention comprises abasic nucleotide, polyether, polyamine, polyamide, peptide, carbohydrate, lipid, polyhydrocarbon, or other polymeric compounds (e.g. polyethylene glycols such as those having between 2 and 100 ethylene glycol units). Specific examples include those described by Seela and Kaiser, *Nucleic Acids Res.* 1990, 18:6353 and *Nucleic Acids Res.* 1987, 15:3113; Cload and Schepartz, *J. Am. Chem. Soc.* 1991, 113:6324; Richardson and Schepartz, *J. Am. Chem. Soc.* 1991, 113:5109; Ma et al., *Nucleic Acids Res.* 1993, 21:2585 and *Biochemistry* 1993, 32:1751; Durand et al., *Nucleic Acids Res.* 1990, 18:6353; McCurdy et al., *Nucleosides & Nucleotides* 1991, 10:287; Jschke et al., *Tetrahedron Lett.* 1993, 34:301; Ono et al., *Biochemistry* 1991, 30:9914; Arnold et al., International Publication No. WO 89/02439; Usman et al., International Publication No. WO 95/06731; Dudycz et al., International Publication No. WO 95/11910 and Ferentz and Verdine, *J. Am. Chem. Soc.* 1991, 113:4000, all hereby incorporated by reference herein. A "non-nucleotide" further means any group or compound that can be incorporated into a nucleic acid chain in the place of one or more nucleotide units, including either sugar and/or phosphate substitutions, and allows the remaining bases to exhibit their enzymatic activity. The group or compound can be abasic in that it does not contain a commonly recognized nucleotide base, such as adenosine, guanine, cytosine, uracil or thymine, for example at the C1 position of the sugar.

In one embodiment, the invention features a short interfering nucleic acid (siNA) molecule capable of mediating RNA interference (RNAi) inside a cell or reconstituted in vitro system, wherein one or both strands of the siNA molecule that are assembled from two separate oligonucleotides do not comprise any ribonucleotides. For example, a siNA molecule can be assembled from a single oligonucleotide where the sense and antisense regions of the siNA comprise separate oligonucleotides that do not have any ribonucleotides (e.g., nucleotides having a 2'-OH group) present in the oligonucleotides. In another example, a siNA molecule can be assembled from a single oligonucleotide where the sense and antisense regions of the siNA are linked or circularized by a nucleotide or non-nucleotide linker as described herein, wherein the oligonucleotide does not have any ribonucleotides (e.g., nucleotides having a 2'-OH group) present in the oligonucleotide. Applicant has surprisingly found that the presence of ribonucleotides (e.g., nucleotides having a 2'-hydroxyl group) within the siNA molecule is not required or essential to support RNAi activity. As such, in one embodiment, all positions within the siNA can include chemically modified nucleotides and/or non-nucleotides such as nucleotides and or non-nucleotides having Formula I, II, III, IV, V, VI, or VII or any combination thereof to the extent that the ability of the siNA molecule to support RNAi activity in a cell is maintained.

In one embodiment, a siNA molecule of the invention is a single stranded siNA molecule that mediates RNAi activity in a cell or reconstituted in vitro system comprising a single stranded polynucleotide having complementarity to a RSV target nucleic acid sequence. In another embodiment, the single stranded siNA molecule of the invention comprises a 5'-terminal phosphate group. In another embodiment, the single stranded siNA molecule of the invention comprises a 5'-terminal phosphate group and a 3'-terminal phosphate group (e.g., a 2',3'-cyclic phosphate). In another embodiment, the single stranded siNA molecule of the invention comprises about 15 to about 30 (e.g., about 15, 16, 17, 18, 19, 20, 21, 22, 23, 24, 25, 26, 27, 28, 29, or 30) nucleotides. In yet another embodiment, the single stranded siNA molecule of the invention comprises one or more chemically modified nucleotides or non-nucleotides described herein. For example, all the positions within the siNA molecule can include chemically-modified nucleotides such as nucleotides having any of Formulae I-VII, or any combination thereof to the extent that the ability of the siNA molecule to support RNAi activity in a cell is maintained.

In one embodiment, a siNA molecule of the invention is a single stranded siNA molecule that mediates RNAi activity in a cell or reconstituted in vitro system comprising a single stranded polynucleotide having complementarity to a RSV target nucleic acid sequence, wherein one or more pyrimidine nucleotides present in the siNA are 2'-deoxy-2'-fluoro, 4'-thio, 2'-O-trifluoromethyl, 2'-O-ethyl-trifluoromethoxy, or 2'-O-difluoromethoxy-ethoxy pyrimidine nucleotides (e.g., wherein all pyrimidine nucleotides are 2'-deoxy-2'-fluoro, 4'-thio, 2'-O-trifluoromethyl, 2'-O-ethyl-trifluoromethoxy, or 2'-O-difluoromethoxy-ethoxy pyrimidine nucleotides or alternately a plurality of pyrimidine nucleotides are 2'-deoxy-2'-fluoro, 4'-thio, 2'-O-trifluoromethyl, 2'-O-ethyl-trifluoromethoxy, or 2'-O-difluoromethoxy-ethoxy pyrimidine nucleotides), and wherein any purine nucleotides present in the antisense region are 2'-O-methyl, 4'-thio, 2'-O-trifluoromethyl, 2'-O-ethyl-trifluoromethoxy, or 2'-O-difluoromethoxy-ethoxy purine nucleotides (e.g., wherein all purine nucleotides are 2'-O-methyl, 4'-thio, 2'-O-trifluoromethyl, 2'-O-ethyl-trifluoromethoxy, or 2'-O-difluoromethoxy-ethoxy purine nucleotides or alternately a plurality of purine nucleotides are 2'-O-methyl, 4'-thio, 2'-O-trifluoromethyl, 2'-O-ethyl-trifluoromethoxy, or 2'-O-difluoromethoxy-ethoxy purine nucleotides), and a terminal cap modification, such as any modification described herein or shown in FIG. 10, that is optionally present at the 3'-end, the 5'-end, or both of the 3' and 5'-ends of the antisense sequence. The siNA optionally further comprises about 1 to about 4 or more (e.g., about 1, 2, 3, 4 or more) terminal 2'-deoxynucleotides at the 3'-end of the siNA molecule, wherein the terminal nucleotides can further comprise one or more (e.g., 1, 2, 3, 4 or more) phosphorothioate, phosphonoacetate, and/or thiophosphonoacetate internucleotide linkages, and wherein the siNA optionally further comprises a terminal phosphate group, such as a 5'-terminal phosphate group. In any of these embodiments, any purine nucleotides present in the antisense region are alternatively 2'-deoxy purine nucleotides (e.g., wherein all purine nucleotides are 2'-deoxy purine nucleotides or alternately a plurality of purine nucleotides are 2'-deoxy purine nucleotides). Also, in any of these embodiments, any purine nucleotides present in the siNA (i.e., purine nucleotides present in the sense and/or antisense region) can alternatively be locked nucleic acid (LNA) nucleotides (e.g., wherein all purine nucleotides are LNA nucleotides or alternately a plurality of purine nucleotides are LNA nucleotides). Also, in any of these embodiments, any purine nucleotides present in the siNA are alternatively 2'-methoxyethyl purine nucleotides (e.g., wherein all purine nucleotides are 2'-methoxyethyl purine nucleotides or alternately a plurality of purine nucleotides are 2'-methoxyethyl purine nucleotides). In another embodiment, any modified nucleotides present in the single stranded siNA molecules of the invention comprise modified nucleotides having properties or characteristics similar to naturally occurring ribonucleotides. For example, the invention features siNA molecules including modified nucleotides having a Northern conformation (e.g., Northern pseudorotation cycle, see for example Saenger, *Principles of Nucleic Acid Structure*, Springer-Verlag ed., 1984). As such, chemically modified nucleotides present in the single stranded siNA molecules of the invention are preferably resistant to nuclease degradation while at the same time maintaining the capacity to mediate RNAi.

In one embodiment, a chemically-modified short interfering nucleic acid (siNA) molecule of the invention comprises a sense strand or sense region having two or more (e.g., 2, 3, 4, 5, 6, 7, 8, 9, 10, 11, 12, 13, 14 15, 16, 17, 18, 19, 20, 21, 22, 23, 24, 25, 26, 27, 28, 29, 30 or more) 2'-O-alkyl (e.g. 2'-O-methyl) modifications or any combination thereof. In another embodiment, the 2'-O-alkyl modification is at alternating position in the sense strand or sense region of the siNA, such as position 1, 3, 5, 7, 9, 11, 13, 15, 17, 19, 21 etc. or position 2, 4, 6, 8, 10, 12, 14, 16, 18, 20 etc.

In one embodiment, a chemically-modified short interfering nucleic acid (siNA) molecule of the invention comprises an antisense strand or antisense region having two or more (e.g., 2, 3, 4, 5, 6, 7, 8, 9, 10, 11, 12, 13, 14 15, 16, 17, 18, 19, 20, 21, 22, 23, 24, 25, 26, 27, 28, 29, 30 or more) 2'-O-alkyl (e.g. 2'-O-methyl) modifications or any combination thereof. In another embodiment, the 2'-O-alkyl modification is at alternating position in the antisense strand or antisense region of the siNA, such as position 1, 3, 5, 7, 9, 11, 13, 15, 17, 19, 21 etc. or position 2, 4, 6, 8, 10, 12, 14, 16, 18, 20 etc.

In one embodiment, a chemically-modified short interfering nucleic acid (siNA) molecule of the invention comprises a sense strand or sense region and an antisense strand or antisense region, each having two or more (e.g., 2, 3, 4, 5, 6, 7, 8, 9, 10, 11, 12, 13, 14 15, 16, 17, 18, 19, 20, 21, 22, 23, 24, 25, 26, 27, 28, 29, 30 or more) 2'-O-alkyl (e.g. 2'-O-methyl), 2'-deoxy-2'-fluoro, 2'-deoxy, or abasic chemical modifications or any combination thereof. In another embodiment, the 2'-O-alkyl modification is at alternating position in the sense strand or sense region of the siNA, such as position 1, 3, 5, 7, 9, 11, 13, 15, 17, 19, 21 etc. or position 2, 4, 6, 8, 10, 12, 14, 16, 18, 20 etc. In another embodiment, the 2'-O-alkyl modification is at alternating position in the antisense strand or antisense region of the siNA, such as position 1, 3, 5, 7, 9, 11, 13, 15, 17, 19, 21 etc. or position 2, 4, 6, 8, 10, 12, 14, 16, 18, 20 etc.

In one embodiment, a siNA molecule of the invention comprises chemically modified nucleotides or non-nucleotides (e.g., having any of Formulae I-VII, such as 2'-deoxy, 2'-deoxy-2'-fluoro, 4'-thio, 2'-O-trifluoromethyl, 2'-O-ethyl-trifluoromethoxy, 2'-O-difluoromethoxy-ethoxy or 2'-O-methyl nucleotides) at alternating positions within one or more strands or regions of the siNA molecule. For example, such chemical modifications can be introduced at every other position of a RNA based siNA molecule, starting at either the first or second nucleotide from the 3'-end or 5'-end of the siNA. In a non-limiting example, a double stranded siNA molecule of the invention in which each strand of the siNA is 21 nucleotides in length is featured wherein positions 1, 3, 5, 7, 9, 11, 13, 15, 17, 19 and 21 of each strand are chemically modified (e.g., with compounds having any of Formulae I-VII, such as such as 2'-deoxy, 2'-deoxy-2'-fluoro, 4'-thio, 2'-O-trifluoromethyl, 2'-O-ethyl-trifluoromethoxy, 2'-O-difluoromethoxy-ethoxy or 2'-O-methyl nucleotides). In another non-limiting example, a double stranded siNA molecule of the invention in which each strand of the siNA is 21 nucleotides in length is featured wherein positions 2, 4, 6, 8, 10, 12, 14, 16, 18, and 20 of each strand are chemically modified (e.g., with compounds having any of Formulae I-VII, such as such as 2'-deoxy, 2'-deoxy-2'-fluoro, 4'-thio, 2'-O-trifluoromethyl, 2'-O-ethyl-trifluoromethoxy, 2'-O-difluoromethoxy-ethoxy or 2'-O-methyl nucleotides). In one embodiment, one strand of the double stranded siNA molecule comprises chemical modifications at positions 2, 4, 6, 8, 10, 12, 14, 16, 18, and 20 and chemical modifications at positions 1, 3, 5, 7, 9, 11, 13, 15, 17, 19 and 21. Such siNA molecules can further comprise terminal cap moieties and/or backbone modifications as described herein.

In one embodiment, a siNA molecule of the invention comprises the following features: if purine nucleotides are present at the 5'-end (e.g., at any of terminal nucleotide positions 1, 2, 3, 4, 5, or 6 from the 5'-end) of the antisense strand or antisense region (otherwise referred to as the guide sequence or guide strand) of the siNA molecule then such purine nucleosides are ribonucleotides. In another embodiment, the purine ribonucleotides, when present, are base paired to nucleotides of the sense strand or sense region (otherwise referred to as the passenger strand) of the siNA molecule. Such purine ribonucleotides can be present in a siNA stabilization motif that otherwise comprises modified nucleotides.

In one embodiment, a siNA molecule of the invention comprises the following features: if pyrimidine nucleotides are present at the 5'-end (e.g., at any of terminal nucleotide positions 1, 2, 3, 4, 5, or 6 from the 5'-end) of the antisense strand or antisense region (otherwise referred to as the guide sequence or guide strand) of the siNA molecule then such pyrimidine nucleosides are ribonucleotides. In another embodiment, the pyrimidine ribonucleotides, when present, are base paired to nucleotides of the sense strand or sense region (otherwise referred to as the passenger strand) of the siNA molecule. Such pyrimidine ribonucleotides can be present in a siNA stabilization motif that otherwise comprises modified nucleotides.

In one embodiment, a siNA molecule of the invention comprises the following features: if pyrimidine nucleotides are present at the 5'-end (e.g., at any of terminal nucleotide positions 1, 2, 3, 4, 5, or 6 from the 5'-end) of the antisense strand or antisense region (otherwise referred to as the guide sequence or guide strand) of the siNA molecule then such pyrimidine nucleosides are modified nucleotides. In another embodiment, the modified pyrimidine nucleotides, when present, are base paired to nucleotides of the sense strand or sense region (otherwise referred to as the passenger strand) of the siNA molecule. Non-limiting examples of modified pyrimidine nucleotides include those having any of Formulae I-VII, such as such as 2'-deoxy, 2'-deoxy-2'-fluoro, 4'-thio, 2'-O-trifluoromethyl, 2'-O-ethyl-trifluoromethoxy, 2'-O-difluoromethoxy-ethoxy or 2'-O-methyl nucleotides.

In one embodiment, the invention features a double stranded nucleic acid molecule having structure SI:

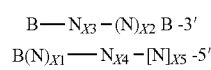

SI wherein each N is independently a nucleotide; each B is a terminal cap moiety that can be present or absent; (N) represents non-base paired or overhanging nucleotides which can be unmodified or chemically modified; [N] represents nucleotide positions wherein any purine nucleotides when present are ribonucleotides; X1 and X2 are independently integers from about 0 to about 4; X3 is an integer from about 9 to about 30; X4 is an integer from about 11 to about 30, provided that the sum of X4 and X5 is between 17-36; X5 is an integer from about 1 to about 6; NX3 is complementary to NX4 and NX5, and (a) any pyrimidine nucleotides present in the antisense strand (lower strand) are 2'-deoxy-2'-fluoro nucleotides; any purine nucleotides present in the antisense strand (lower strand) other than the purines nucleotides in the [N] nucleotide positions, are independently 2'-O-methyl nucleotides, 2'-deoxyribonucleotides or a combination of 2'-deoxyribonucleotides and 2'-O-methyl nucleotides;

(b) any pyrimidine nucleotides present in the sense strand (upper strand) are 2'-deoxy-2'-fluoro nucleotides; any purine nucleotides present in the sense strand (upper strand) are independently 2'-deoxyribonucleotides, 2'-O-methyl nucleotides or a combination of 2'-deoxyribonucleotides and 2'-O-methyl nucleotides; and (c) any (N) nucleotides are optionally 2'-O-methyl, 2'-deoxy-2'-fluoro, or deoxyribonucleotides.

In one embodiment, the invention features a double stranded nucleic acid molecule having structure SII:

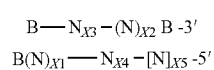

SII wherein each N is independently a nucleotide; each B is a terminal cap moiety that can be present or absent; (N) represents non-base paired or overhanging nucleotides which can be unmodified or chemically modified; [N] represents nucleotide positions wherein any purine nucleotides when present are ribonucleotides; X1 and X2 are independently integers from about 0 to about 4; X3 is an integer from about 9 to about 30; X4 is an integer from about 11 to about 30, provided that the sum of X4 and X5 is between 17-36; X5 is an integer from about 1 to about 6; NX3 is complementary to NX4 and NX5, and (a) any pyrimidine nucleotides present in the antisense strand (lower strand) are 2'-deoxy-2'-fluoro nucleotides; any purine nucleotides present in the antisense strand (lower strand) other than the purines nucleotides in the [N] nucleotide positions, are 2'-O-methyl nucleotides;

(b) any pyrimidine nucleotides present in the sense strand (upper strand) are ribonucleotides; any purine nucleotides present in the sense strand (upper strand) are ribonucleotides; and (c) any (N) nucleotides are optionally 2'-O-methyl, 2'-deoxy-2'-fluoro, or deoxyribonucleotides.

In one embodiment, the invention features a double stranded nucleic acid molecule having structure SIII:

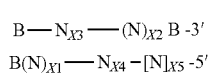

SIII wherein each N is independently a nucleotide; each B is a terminal cap moiety that can be present or absent; (N) represents non-base paired or overhanging nucleotides which can be unmodified or chemically modified; [N] represents nucleotide positions wherein any purine nucleotides when present are ribonucleotides; X1 and X2 are independently integers from about 0 to about 4; X3 is an integer from about 9 to about 30; X4 is an integer from about 11 to about 30, provided that the sum of X4 and X5 is between 17-36; X5 is an integer from about 1 to about 6; NX3 is complementary to NX4 and NX5, and (a) any pyrimidine nucleotides present in the antisense strand (lower strand) are 2'-deoxy-2'-fluoro nucleotides; any purine nucleotides present in the antisense strand (lower strand) other than the purines nucleotides in the [N] nucleotide positions, are 2'-O-methyl nucleotides;

(b) any pyrimidine nucleotides present in the sense strand (upper strand) are 2'-deoxy-2'-fluoro nucleotides; any purine nucleotides present in the sense strand (upper strand) are ribonucleotides; and (c) any (N) nucleotides are optionally 2'-O-methyl, 2'-deoxy-2'-fluoro, or deoxyribonucleotides.

In one embodiment, the invention features a double stranded nucleic acid molecule having structure SIV:

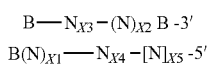

wherein each N is independently a nucleotide; each B is a terminal cap moiety that can be present or absent; (N) represents non-base paired or overhanging nucleotides which can be unmodified or chemically modified; [N] represents nucleotide positions wherein any purine nucleotides when present are ribonucleotides; X1 and X2 are independently integers from about 0 to about 4; X3 is an integer from about 9 to about 30; X4 is an integer from about 11 to about 30, provided that the sum of X4 and X5 is between 17-36; X5 is an integer from about 1 to about 6; NX3 is complementary to NX4 and NX5, and (a) any pyrimidine nucleotides present in the antisense strand (lower strand) are 2'-deoxy-2'-fluoro nucleotides; any purine nucleotides present in the antisense strand (lower strand) other than the purines nucleotides in the [N] nucleotide positions, are 2'-O-methyl nucleotides;

(b) any pyrimidine nucleotides present in the sense strand (upper strand) are 2'-deoxy-2'-fluoro nucleotides; any purine nucleotides present in the sense strand (upper strand) are deoxyribonucleotides; and (c) any (N) nucleotides are optionally 2'-O-methyl, 2'-deoxy-2'-fluoro, or deoxyribonucleotides.

In one embodiment, the invention features a double stranded nucleic acid molecule having structure SV:

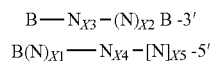

wherein each N is independently a nucleotide; each B is a terminal cap moiety that can be present or absent; (N) represents non-base paired or overhanging nucleotides which can be unmodified or chemically modified; [N] represents nucleotide positions wherein any purine nucleotides when present are ribonucleotides; X1 and X2 are independently integers from about 0 to about 4; X3 is an integer from about 9 to about 30; X4 is an integer from about 11 to about 30, provided that the sum of X4 and X5 is between 17-36; X5 is an integer from about 1 to about 6; NX3 is complementary to NX4 and NX5, and (a) any pyrimidine nucleotides present in the antisense strand (lower strand) are nucleotides having a ribo-like configuration (e.g., Northern or A-form helix configuration); any purine nucleotides present in the antisense strand (lower strand) other than the purines nucleotides in the [N] nucleotide positions, are 2'-O-methyl nucleotides;

(b) any pyrimidine nucleotides present in the sense strand (upper strand) are nucleotides having a ribo-like configuration (e.g., Northern or A-form helix configuration); any purine nucleotides present in the sense strand (upper strand) are 2'-O-methyl nucleotides; and (c) any (N) nucleotides are optionally 2'-O-methyl, 2'-deoxy-2'-fluoro, or deoxyribonucleotides.

In one embodiment, the invention features a double stranded nucleic acid molecule having structure SVI:

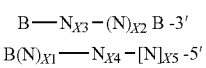

wherein each N is independently a nucleotide; each B is a terminal cap moiety that can be present or absent; (N) represents non-base paired or overhanging nucleotides which can be unmodified or chemically modified; [N] represents nucleotide positions comprising sequence that renders the 5'-end of the antisense strand (lower strand) less thermally stable than the 5'-end of the sense strand (upper strand); X1 and X2 are independently integers from about 0 to about 4; X3 is an integer from about 9 to about 30; X4 is an integer from about 11 to about 30, provided that the sum of X4 and X5 is between 17-36; X5 is an integer from about 1 to about 6; NX3 is complementary to NX4 and NX5, and (a) any pyrimidine nucleotides present in the antisense strand (lower strand) are 2'-deoxy-2'-fluoro nucleotides; any purine nucleotides present in the antisense strand (lower strand) other than the purines nucleotides in the [N] nucleotide positions, are independently 2'-O-methyl nucleotides, 2'-deoxyribonucleotides or a combination of 2'-deoxyribonucleotides and 2'-O-methyl nucleotides;

(b) any pyrimidine nucleotides present in the sense strand (upper strand) are 2'-deoxy-2'-fluoro nucleotides; any purine nucleotides present in the sense strand (upper strand) are independently 2'-deoxyribonucleotides, 2'-O-methyl nucleotides or a combination of 2'-deoxyribonucleotides and 2'-O-methyl nucleotides; and (c) any (N) nucleotides are optionally 2'-O-methyl, 2'-deoxy-2'-fluoro, or deoxyribonucleotides.

In one embodiment, the invention features a double stranded nucleic acid molecule having structure SVII:

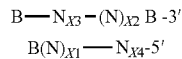

wherein each N is independently a nucleotide; each B is a terminal cap moiety that can be present or absent; (N) represents non-base paired or overhanging nucleotides; X1 and X2 are independently integers from about 0 to about 4; X3 is an integer from about 9 to about 30; X4 is an integer from about 11 to about 30; NX3 is complementary to NX4, and any (N) nucleotides are 2'-O-methyl and/or 2'-deoxy-2'-fluoro nucleotides.

In one embodiment, the invention features a double stranded nucleic acid molecule having structure SVIII:

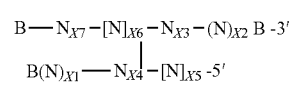

wherein each N is independently a nucleotide; each B is a terminal cap moiety that can be present or absent; (N) represents non-base paired or overhanging nucleotides which can be unmodified or chemically modified; [N] represents nucleotide positions comprising sequence that renders the 5'-end of the antisense strand (lower strand) less thermally stable than the 5'-end of the sense strand (upper strand); [N] represents nucleotide positions that are ribonucleotides; X1 and X2 are independently integers from about 0 to about 4; X3 is an integer from about 9 to about 15; X4 is an integer from about 11 to about 30, provided that the sum of X4 and X5 is between 17-36; X5 is an integer from about 1 to about 6; X6 is an integer from about 1 to about 4; X7 is an integer from about 9 to about 15; NX7, NX6, and NX3 are complementary to NX4 and NX5, and (a) any pyrimidine nucleotides present in the antisense strand (lower strand) are 2'-deoxy-2'-fluoro nucleotides; any purine nucleotides present in the antisense strand (lower strand) other than the purines nucleotides in the [N] nucleotide positions, are independently 2'-O-methyl nucleotides, 2'-deoxyribonucleotides or a combination of 2'-deoxyribonucleotides and 2'-O-methyl nucleotides;

(b) any pyrimidine nucleotides present in the sense strand (upper strand) are 2'-deoxy-2'-fluoro nucleotides other than [N] nucleotides; any purine nucleotides present in the sense strand (upper strand) are independently 2'-deoxyribonucleotides, 2'-O-methyl nucleotides or a combination of 2'-deoxyribonucleotides and 2'-O-methyl nucleotides other than [N] nucleotides; and (c) any (N) nucleotides are optionally 2'-O-methyl, 2'-deoxy-2'-fluoro, or deoxyribonucleotides.

In one embodiment, a double stranded nucleic acid molecule having any of structure SI, SII, SIII, SIV, SV, SVI, SVII or SVIII comprises a terminal phosphate group at the 5'-end of the antisense strand or antisense region of the nucleic acid molecule.

In one embodiment, a double stranded nucleic acid molecule having any of structure SI, SII, SIII, SIV, SV, SVI, SVII or SVIII comprises X5=1, 2, or 3; each X1 and X2=1 or 2; X3=12, 13, 14, 15, 16, 17, 18, 19, 20, 21, 22, 23, 24, 25, 26, 27, 28, 29, or 30, and X4=15, 16, 17, 18, 19, 20, 21, 22, 23, 24, 25, 26, 27, 28, 29, or 30.

In one embodiment, a double stranded nucleic acid molecule having any of structure SI, SII, SIII, SIV, SV, SVI, SVII or SVIII comprises X5=1; each X1 and X2=2; X3=19, and X4=18.

In one embodiment, a double stranded nucleic acid molecule having any of structure SI, SII, SIII, SIV, SV, SVI, SVII or SVIII comprises X5=2; each X1 and X2=2; X3=19, and X4=17

In one embodiment, a double stranded nucleic acid molecule having any of structure SI, SII, SIII, SIV, SV, SVI, SVII or SVIII comprises X5=3; each X1 and X2=2; X3=19, and X4=16.

In one embodiment, a double stranded nucleic acid molecule having any of structure SI, SII, SIII, SIV, SV, SVI, SVII or SVIII comprises B at the 3' and 5' ends of the sense strand or sense region.

In one embodiment, a double stranded nucleic acid molecule having any of structure SI, SII, SIII, SIV, SV, SVI, SVII or SVIII comprises B at the 3'-end of the antisense strand or antisense region.

In one embodiment, a double stranded nucleic acid molecule having any of structure SI, SII, SIII, SIV, SV, SVI, SVII or SVIII comprises B at the 3' and 5' ends of the sense strand or sense region and B at the 3'-end of the antisense strand or antisense region.

In one embodiment, a double stranded nucleic acid molecule having any of structure SI, SII, SIII, SIV, SV, SVI, SVII or SVIII further comprises one or more phosphorothioate internucleotide linkages at the first terminal (N) on the 3' end of the sense strand, antisense strand, or both sense strand and antisense strands of the nucleic acid molecule. For example, a double stranded nucleic acid molecule can comprise X1 and/or X2=2 having overhanging nucleotide positions with a phosphorothioate internucleotide linkage, e.g., (NsN) where "s" indicates phosphorothioate.

In one embodiment, a double stranded nucleic acid molecule having any of structure SI, SII, SIII, SIV, SV, SVI, SVII or SVIII comprises (N) nucleotides that are 2'-O-methyl nucleotides.

In one embodiment, a double stranded nucleic acid molecule having any of structure SI, SII, SIII, SIV, SV, SVI, SVII or SVIII comprises (N) nucleotides that are 2'-O-methyl nucleotides.

In one embodiment, a double stranded nucleic acid molecule having any of structure SI, SII, SIII, SIV, SV, SVI, SVII or SVIII comprises (N) nucleotides in the antisense strand (lower strand) that are complementary to nucleotides in a RSV target polynucleotide sequence having complementary to the N and [N] nucleotides of the antisense (lower) strand.

In one embodiment, a double stranded nucleic acid molecule having any of structure SI, SII, SIII, SIV, SV, SVI, SVII or SVIII comprises (N) nucleotides in the sense strand (upper strand) that comprise nucleotide sequence corresponding a RSV target polynucleotide sequence having complementary to the antisense (lower) strand such that the contiguous (N) and N nucleotide sequence of the sense strand comprises nucleotide sequence of the RSV target nucleic acid sequence.

In one embodiment, a double stranded nucleic acid molecule having any of structure SVIII comprises B only at the 5'-end of the sense (upper) strand of the double stranded nucleic acid molecule.

In one embodiment, a double stranded nucleic acid molecule having any of structure SI, SII, SIII, SIV, SV, SVI, SVII or SVIII further comprises an unpaired terminal nucleotide at the 5'-end of the antisense (lower) strand. The unpaired nucleotide is not complementary to the sense (upper) strand. In one embodiment, the unpaired terminal nucleotide is complementary to a RSV target polynucleotide sequence having complementary to the N and [N] nucleotides of the antisense (lower) strand. In another embodiment, the unpaired terminal nucleotide is not complementary to a RSV target polynucleotide sequence having complementary to the N and [N] nucleotides of the antisense (lower) strand.

In one embodiment, a double stranded nucleic acid molecule having any of structure SVIII comprises X6=1 and X3=10.

In one embodiment, a double stranded nucleic acid molecule having any of structure SVIII comprises X6=2 and X3=9.

In one embodiment, the invention features a composition comprising a siNA molecule or double stranded nucleic acid molecule formulated as any of formulation LNP-051; LNP-053; LNP-054; LNP-069; LNP-073; LNP-077; LNP-080; LNP-082; LNP-083; LNP-060; LNP-061; LNP-086; LNP-097; LNP-098; LNP-099; LNP-100; LNP-101; LNP-102; LNP-103; or LNP-104 (see Table VI).

In one embodiment, the invention features a composition comprising a first double stranded nucleic and a second double stranded nucleic acid molecule each having a first strand and a second strand that are complementary to each other, wherein the second strand of the first double stranded nucleic acid molecule comprises sequence complementary to a first RSV target sequence and the second strand of the second double stranded nucleic acid molecule comprises sequence complementary to a second RSV target sequence.

In one embodiment, the composition further comprises a cationic lipid, a neutral lipid, and a polyethyleneglycol-conjugate. In one embodiment, the composition further comprises a cationic lipid, a neutral lipid, a polyethyleneglycol-conjugate, and a cholesterol. In one embodiment, the composition further comprises a polyethyleneglycol-conjugate, a cholesterol, and a surfactant. In one embodiment, the cationic lipid is selected from the group consisting of CLinDMA, pCLinDMA, eCLinDMA, DMOBA, and DMLBA. In one embodiment, the neutral lipid is selected from the group consisting of DSPC, DOBA, and cholesterol. In one embodiment, the polyethyleneglycol-conjugate is selected from the group consisting of a PEG-dimyristoyl glycerol and PEG-cholesterol. In one embodiment, the PEG is 2 KPEG. In one embodiment, the surfactant is selected from the group consisting of palmityl alcohol, stearyl alcohol, oleyl alcohol and linoleyl alcohol. In one embodiment, the cationic lipid is CLinDMA, the neutral lipid is DSPC, the polyethylene glycol conjugate is 2 KPEG-DMG, the cholesterol is cholesterol, and the surfactant is linoleyl alcohol. In one embodiment, the CLinDMA, the DSPC, the 2 KPEG-DMG, the cholesterol, and the linoleyl alcohol are present in molar ratio of 43:38:10:2:7 respectively.

In one embodiment, the invention features a method for modulating the expression of a RSV target gene within a cell comprising: (a) synthesizing a siNA molecule of the invention, which can be chemically-modified or unmodified, wherein one of the siNA strands comprises a sequence complementary to RNA of the RSV target gene; and (b) introducing the siNA molecule into a cell under conditions suitable to modulate (e.g., inhibit) the expression of the RSV target gene in the cell.

In one embodiment, the invention features a method for modulating the expression of a RSV target gene within a cell comprising: (a) synthesizing a siNA molecule of the invention, which can be chemically-modified or unmodified, wherein one of the siNA strands comprises a sequence complementary to RNA of the RSV target gene and wherein the sense strand sequence of the siNA comprises a sequence identical or substantially similar to the sequence of the RSV target RNA; and (b) introducing the siNA molecule into a cell under conditions suitable to modulate (e.g., inhibit) the expression of the RSV target gene in the cell.

In another embodiment, the invention features a method for modulating the expression of more than one RSV target gene within a cell comprising: (a) synthesizing siNA molecules of the invention, which can be chemically-modified or unmodified, wherein one of the siNA strands comprises a sequence complementary to RNA of the RSV target genes; and (b) introducing the siNA molecules into a cell under conditions suitable to modulate (e.g., inhibit) the expression of the RSV target genes in the cell.

In another embodiment, the invention features a method for modulating the expression of two or more RSV target genes within a cell comprising: (a) synthesizing one or more siNA molecules of the invention, which can be chemically-modified or unmodified, wherein the siNA strands comprise sequences complementary to RNA of the RSV target genes and wherein the sense strand sequences of the siNAs comprise sequences identical or substantially similar to the sequences of the RSV target RNAs; and (b) introducing the siNA molecules into a cell under conditions suitable to modulate (e.g., inhibit) the expression of the RSV target genes in the cell.

In another embodiment, the invention features a method for modulating the expression of more than one RSV target gene within a cell comprising: (a) synthesizing a siNA molecule of the invention, which can be chemically-modified or unmodified, wherein one of the siNA strands comprises a sequence complementary to RNA of the RSV target gene and wherein the sense strand sequence of the siNA comprises a sequence identical or substantially similar to the sequences of the RSV target RNAs; and (b) introducing the siNA molecule into a cell under conditions suitable to modulate (e.g., inhibit) the expression of the RSV target genes in the cell.

In another embodiment, the invention features a method for modulating the expression of a RSV target gene within a cell comprising: (a) synthesizing a siNA molecule of the invention, which can be chemically-modified or unmodified, wherein one of the siNA strands comprises a sequence complementary to RNA of the RSV target gene, wherein the sense strand sequence of the siNA comprises a sequence identical or substantially similar to the sequences of the RSV target RNA; and (b) introducing the siNA molecule into a cell under conditions suitable to modulate (e.g., inhibit) the expression of the RSV target gene in the cell.

In one embodiment, siNA molecules of the invention are used as reagents in ex vivo applications. For example, siNA reagents are introduced into tissue or cells that are transplanted into a subject for therapeutic effect. The cells and/or tissue can be derived from an organism or subject that later receives the explant, or can be derived from another organism or subject prior to transplantation. The siNA molecules can be used to modulate the expression of one or more genes in the cells or tissue, such that the cells or tissue obtain a desired phenotype or are able to perform a function when transplanted in vivo. In one embodiment, certain RSV target cells from a patient are extracted. These extracted cells are contacted with siNAs RSV targeting a specific nucleotide sequence within the cells under conditions suitable for uptake of the siNAs by these cells (e.g. using delivery reagents such as cationic lipids, liposomes and the like or using techniques such as electroporation to facilitate the delivery of siNAs into cells). The cells are then reintroduced back into the same patient or other patients.

In one embodiment, the invention features a method of modulating the expression of a RSV target gene in a tissue explant comprising: (a) synthesizing a siNA molecule of the invention, which can be chemically-modified, wherein one of the siNA strands comprises a sequence complementary to RNA of the RSV target gene; and (b) introducing the siNA molecule into a cell of the tissue explant derived from a particular organism under conditions suitable to modulate (e.g., inhibit) the expression of the RSV target gene in the tissue explant. In another embodiment, the method further comprises introducing the tissue explant back into the organism the tissue was derived from or into another organism under conditions suitable to modulate (e.g., inhibit) the expression of the RSV target gene in that organism.

In one embodiment, the invention features a method of modulating the expression of a RSV target gene in a tissue explant comprising: (a) synthesizing a siNA molecule of the invention, which can be chemically-modified, wherein one of the siNA strands comprises a sequence complementary to RNA of the RSV target gene and wherein the sense strand sequence of the siNA comprises a sequence identical or substantially similar to the sequence of the RSV target RNA; and (b) introducing the siNA molecule into a cell of the tissue explant derived from a particular organism under conditions suitable to modulate (e.g., inhibit) the expression of the RSV target gene in the tissue explant. In another embodiment, the method further comprises introducing the tissue explant back into the organism the tissue was derived from or into another organism under conditions suitable to modulate (e.g., inhibit) the expression of the RSV target gene in that organism.

In another embodiment, the invention features a method of modulating the expression of more than one RSV target gene in a tissue explant comprising: (a) synthesizing siNA molecules of the invention, which can be chemically-modified, wherein one of the siNA strands comprises a sequence complementary to RNA of the RSV target genes; and (b) introducing the siNA molecules into a cell of the tissue explant derived from a particular organism under conditions suitable to modulate (e.g., inhibit) the expression of the RSV target genes in the tissue explant. In another embodiment, the method further comprises introducing the tissue explant back into the organism the tissue was derived from or into another organism under conditions suitable to modulate (e.g., inhibit) the expression of the RSV target genes in that organism.

In one embodiment, the invention features a method of modulating the expression of a RSV target gene in a subject or organism comprising: (a) synthesizing a siNA molecule of the invention, which can be chemically-modified, wherein one of the siNA strands comprises a sequence complementary to RNA of the RSV target gene; and (b) introducing the siNA molecule into the subject or organism under conditions suitable to modulate (e.g., inhibit) the expression of the RSV target gene in the subject or organism. The level of RSV target protein or RNA can be determined using various methods well-known in the art.

In another embodiment, the invention features a method of modulating the expression of more than one RSV target gene in a subject or organism comprising: (a) synthesizing siNA molecules of the invention, which can be chemically-modified, wherein one of the siNA strands comprises a sequence complementary to RNA of the RSV target genes; and (b) introducing the siNA molecules into the subject or organism under conditions suitable to modulate (e.g., inhibit) the expression of the RSV target genes in the subject or organism. The level of RSV target protein or RNA can be determined as is known in the art.

In one embodiment, the invention features a method for modulating the expression of a RSV target gene within a cell (e.g., a lung or lung epithelial cell) comprising: (a) synthesizing a siNA molecule of the invention, which can be chemically-modified, wherein the siNA comprises a single stranded sequence having complementarity to RNA of the RSV target gene; and (b) introducing the siNA molecule into a cell under conditions suitable to modulate (e.g., inhibit) the expression of the RSV target gene in the cell.

In another embodiment, the invention features a method for modulating the expression of more than one RSV target gene within a cell (e.g., a lung or lung epithelial cell) comprising: (a) synthesizing siNA molecules of the invention, which can be chemically-modified, wherein the siNA comprises a single stranded sequence having complementarity to RNA of the RSV target gene; and (b) contacting the cell in vitro or in vivo with the siNA molecule under conditions suitable to modulate (e.g., inhibit) the expression of the RSV target genes in the cell.

In one embodiment, the invention features a method of modulating the expression of a RSV target gene in a tissue explant ((e.g., lung or any other organ, tissue or cell as can be transplanted from one organism to another or back to the same organism from which the organ, tissue or cell is derived) comprising: (a) synthesizing a siNA molecule of the invention, which can be chemically-modified, wherein the siNA comprises a single stranded sequence having complementarity to RNA of the RSV target gene; and (b) contacting a cell of the tissue explant derived from a particular subject or organism with the siNA molecule under conditions suitable to modulate (e.g., inhibit) the expression of the RSV target gene in the tissue explant. In another embodiment, the method further comprises introducing the tissue explant back into the subject or organism the tissue was derived from or into another subject or organism under conditions suitable to modulate (e.g., inhibit) the expression of the RSV target gene in that subject or organism.

In another embodiment, the invention features a method of modulating the expression of more than one RSV target gene in a tissue explant (e.g., lung or any other organ, tissue or cell as can be transplanted from one organism to another or back to the same organism from which the organ, tissue or cell is derived) comprising: (a) synthesizing siNA molecules of the invention, which can be chemically-modified, wherein the siNA comprises a single stranded sequence having complementarity to RNA of the RSV target gene; and (b) introducing the siNA molecules into a cell of the tissue explant derived from a particular subject or organism under conditions suitable to modulate (e.g., inhibit) the expression of the RSV target genes in the tissue explant. In another embodiment, the method further comprises introducing the tissue explant back into the subject or organism the tissue was derived from or into another subject or organism under conditions suitable to modulate (e.g., inhibit) the expression of the RSV target genes in that subject or organism.

In one embodiment, the invention features a method of modulating the expression of a RSV target gene in a subject or organism comprising: (a) synthesizing a siNA molecule of the invention, which can be chemically-modified, wherein the siNA comprises a single stranded sequence having complementarity to RNA of the RSV target gene; and (b) introducing the siNA molecule into the subject or organism under conditions suitable to modulate (e.g., inhibit) the expression of the RSV target gene in the subject or organism.

In another embodiment, the invention features a method of modulating the expression of more than one RSV target gene in a subject or organism comprising: (a) synthesizing siNA molecules of the invention, which can be chemically-modified, wherein the siNA comprises a single stranded sequence having complementarity to RNA of the RSV target gene; and (b) introducing the siNA molecules into the subject or organism under conditions suitable to modulate (e.g., inhibit) the expression of the RSV target genes in the subject or organism.

In one embodiment, the invention features a method of modulating the expression of a RSV target gene in a subject or organism comprising contacting the subject or organism with a siNA molecule of the invention under conditions suitable to modulate (e.g., inhibit) the expression of the RSV target gene in the subject or organism.

In one embodiment, the invention features a method for treating or preventing a disease, disorder, trait or condition related to gene expression in a subject or organism comprising contacting the subject or organism with a siNA molecule of the invention under conditions suitable to modulate the expression of the RSV target gene in the subject or organism. The reduction of gene expression and thus reduction in the level of the respective protein/RNA relieves, to some extent, the symptoms of the disease, disorder, trait or condition.

In one embodiment, the invention features a method for treating or preventing RSV infection in a subject or organism comprising contacting the subject or organism with a siNA molecule of the invention under conditions suitable to modulate the expression of the RSV target gene in the subject or organism whereby the treatment or prevention of RSV infection can be achieved. In one embodiment, the invention features contacting the subject or organism with a siNA molecule of the invention via local administration to relevant tissues or cells, such as liver cells and tissues. In one embodiment, the invention features contacting the subject or organism with a siNA molecule of the invention via systemic administration (such as via intravenous or subcutaneous administration of siNA) to relevant tissues or cells, such as tissues or cells involved in the maintenance or development of RSV infection in a subject or organism. The siNA molecule of the invention can be formulated or conjugated as described herein or otherwise known in the art to target appropriate tissues or cells in the subject or organism. The siNA molecule can be combined with other therapeutic treatments and modalities as are known in the art for the treatment of or prevention of RSV infection in a subject or organism.

In one embodiment, the invention features a method for treating or preventing respiratory distress in a subject or organism comprising contacting the subject or organism with a siNA molecule of the invention under conditions suitable to modulate the expression of the RSV target gene in the subject or organism whereby the treatment or prevention of respiratory failure can be achieved. In one embodiment, the invention features contacting the subject or organism with a siNA molecule of the invention via local administration to relevant tissues or cells, such as lung cells and tissues involved in respiratory failure. In one embodiment, the invention features contacting the subject or organism with a siNA molecule of the invention via systemic administration (such as via intravenous or subcutaneous administration of siNA) to relevant tissues or cells, such as tissues or cells involved in the maintenance or development of the respiratory failure or condition in a subject or organism. The siNA molecule of the invention can be formulated or conjugated as described herein or otherwise known in the art to target appropriate tissues or cells in the subject or organism. The siNA molecule can be combined with other therapeutic treatments and modalities as are known in the art for the treatment of or prevention of respiratory failure in a subject or organism.

In one embodiment, the invention features a method for treating or preventing bronchiolitis in a subject or organism comprising contacting the subject or organism with a siNA molecule of the invention under conditions suitable to modulate the expression of the RSV target gene in the subject or organism whereby the treatment or prevention of bronchiolitis can be achieved. In one embodiment, the invention features contacting the subject or organism with a siNA molecule of the invention via local administration to relevant tissues or cells, such as liver cells and tissues involved in bronchiolitis. In one embodiment, the invention features contacting the subject or organism with a siNA molecule of the invention via systemic administration (such as via intravenous or subcutaneous administration of siNA) to relevant tissues or cells, such as tissues or cells involved in the maintenance or development of bronchiolitis in a subject or organism. The siNA molecule of the invention can be formulated or conjugated as described herein or otherwise known in the art to target appropriate tissues or cells in the subject or organism. The siNA molecule can be combined with other therapeutic treatments and modalities as are known in the art for the treatment of or prevention of bronchiolitis in a subject or organism.

In one embodiment, the invention features a method for treating or preventing pneumonia in a subject or organism comprising contacting the subject or organism with a siNA molecule of the invention under conditions suitable to modulate the expression of the RSV target gene in the subject or organism whereby the treatment or prevention of pneumonia can be achieved. In one embodiment, the invention features contacting the subject or organism with a siNA molecule of the invention via local administration to relevant tissues or cells, such as cells and tissues involved in pneumonia. In one embodiment, the invention features contacting the subject or organism with a siNA molecule of the invention via systemic administration (such as via intravenous or subcutaneous administration of siNA) to relevant tissues or cells, such as tissues or cells involved in the maintenance or development of pneumonia in a subject or organism. The siNA molecule of the invention can be formulated or conjugated as described herein or otherwise known in the art to target appropriate tissues or cells in the subject or organism. The siNA molecule can be combined with other therapeutic treatments and modalities as are known in the art for the treatment of or prevention of pneumonia in a subject or organism.

In one embodiment, the invention features a method for treating or preventing RSV infection in a subject or organism comprising contacting the subject or organism with a siNA molecule of the invention under conditions suitable to modulate (e.g., inhibit) the expression of an inhibitor of RSV gene expression in the subject or organism.

In one embodiment, the invention features a method for treating or preventing respiratory failure in a subject or organism comprising contacting the subject or organism with a siNA molecule of the invention under conditions suitable to modulate (e.g., inhibit) the expression of an inhibitor of RSV gene expression in the subject or organism.

In one embodiment, the invention features a method for treating or preventing bronchiolitis in a subject or organism comprising contacting the subject or organism with a siNA molecule of the invention under conditions suitable to modulate (e.g., inhibit) the expression of an inhibitor of RSV gene expression in the subject or organism.

In one embodiment, the invention features a method for treating or preventing pneumonia in a subject or organism comprising contacting the subject or organism with a siNA molecule of the invention under conditions suitable to modulate (e.g., inhibit) the expression of an inhibitor of RSV gene expression in the subject or organism.

In one embodiment, the invention features a method for treating or preventing Respiratory syncytial virus (RSV) infection in a subject, comprising administering to the subject PEG Interferon in combination with a siNA molecule of the invention; wherein the PEG Interferon and the siNA molecule are administered under conditions suitable for reducing or inhibiting the level of Respiratory syncytial virus (RSV) in the subject compared to a subject not treated with the PEG Interferon and the siNA molecule. In one embodiment, a siNA molecule of the invention is formulated as a composition described in U.S. Provisional patent application No. 60/678,531 and in related U.S. Provisional patent application No. 60/703,946, filed Jul. 29, 2005, and U.S. Provisional patent application No. 60/737,024, filed Nov. 15, 2005 (Vargeese et al.), all of which are incorporated by reference herein in their entirety. Such siNA formulations are generally referred to as "lipid nucleic acid particles" (LNP).

In one embodiment, the invention features a method for treating or preventing Respiratory syncytial virus (RSV) infection in a subject, comprising administering to the subject ribavirin in combination with a siNA molecule of the invention; wherein the ribavirin and the siNA are administered under conditions suitable for reducing or inhibiting the level of Respiratory syncytial virus (RSV) in the subject compared to a subject not treated with the ribavirin and the siNA molecule. In one embodiment, the siNA molecule or double stranded nucleic acid molecule of the invention is formulated as a composition described in U.S. Provisional patent application No. 60/678,531 and in related U.S. Provisional patent application No. 60/703,946, filed Jul. 29, 2005, and U.S. Provisional patent application No. 60/737,024, filed Nov. 15, 2005 (Vargeese et al.).

In one embodiment, the invention features a method for treating or preventing Respiratory syncytial virus (RSV) infection in a subject, comprising administering to the subject PEG Interferon and ribavirin in combination with a siNA molecule of the invention; wherein the PEG Interferon and ribavirin and the siNA molecule are administered under conditions suitable for reducing or inhibiting the level of Respiratory syncytial virus (RSV) in the subject compared to a subject not treated with the PEG Interferon and ribavirin and the siNA molecule. In one embodiment, the siNA molecule or double stranded nucleic acid molecule of the invention is formulated as a composition described in U.S. Provisional patent application No. 60/678,531 and in related U.S. Provisional patent application No. 60/703,946, filed Jul. 29, 2005, and U.S. Provisional patent application No. 60/737,024, filed Nov. 15, 2005 (Vargeese et al.).

In one embodiment, the invention features a method for treating or preventing Respiratory syncytial virus (RSV) infection in a subject, comprising administering to the subject PEG Interferon in combination with a chemically synthesized double stranded nucleic acid molecule; wherein (a) the double stranded nucleic acid molecule comprises a sense strand and an antisense strand; (b) each strand of the double stranded nucleic acid molecule is 15 to 28 nucleotides in length; (c) at least 15 nucleotides of the sense strand are complementary to the antisense strand (d) the antisense strand of the double stranded nucleic acid molecule has complementarity to a Respiratory syncytial virus (RSV) RSV target RNA; and wherein the PEG Interferon and the double stranded nucleic acid molecule are administered under conditions suitable for reducing or inhibiting the level of Respiratory syncytial virus (RSV) in the subject compared to a subject not treated with the PEG Interferon and the double stranded nucleic acid molecule. In one embodiment, the siNA molecule or double stranded nucleic acid molecule of the invention is formulated as a composition described in U.S. Provisional patent application No. 60/678,531 and in related U.S. Provisional patent application No. 60/703,946, filed Jul. 29, 2005, and U.S. Provisional patent application No. 60/737,024, filed Nov. 15, 2005 (Vargeese et al.).

In one embodiment, the invention features a method for treating or preventing Respiratory syncytial virus (RSV) infection in a subject, comprising administering to the subject ribavirin in combination with a chemically synthesized double stranded nucleic acid molecule; wherein (a) the double stranded nucleic acid molecule comprises a sense strand and an antisense strand; (b) each strand of the double stranded nucleic acid molecule is 15 to 28 nucleotides in length; (c) at least 15 nucleotides of the sense strand are complementary to the antisense strand (d) the antisense strand of the double stranded nucleic acid molecule has complementarity to a Respiratory syncytial virus (RSV) RSV target RNA; and wherein the ribavirin and the double stranded nucleic acid molecule are administered under conditions suitable for reducing or inhibiting the level of Respiratory syncytial virus (RSV) in the subject compared to a subject not treated with the ribavirin and the double stranded nucleic acid molecule. In one embodiment, the siNA molecule or double stranded nucleic acid molecule of the invention is formulated as a composition described in U.S. Provisional patent application No. 60/678,531 and in related U.S. Provisional patent application No. 60/703,946, filed Jul. 29, 2005, and U.S. Provisional patent application No. 60/737,024, filed Nov. 15, 2005 (Vargeese et al.).

In one embodiment, the invention features a method for treating or preventing Respiratory syncytial virus (RSV) infection in a subject, comprising administering to the subject PEG Interferon and ribavirin in combination with a chemically synthesized double stranded nucleic acid molecule; wherein (a) the double stranded nucleic acid molecule comprises a sense strand and an antisense strand; (b) each strand of the double stranded nucleic acid molecule is 15 to 28 nucleotides in length; (c) at least 15 nucleotides of the sense strand are complementary to the antisense strand (d) the antisense strand of the double stranded nucleic acid molecule has complementarity to a Respiratory syncytial virus (RSV) RSV target RNA; and wherein the PEG Interferon and ribavirin and the double stranded nucleic acid molecule are administered under conditions suitable for reducing or inhibiting the level of Respiratory syncytial virus (RSV) in the subject compared to a subject not treated with the PEG Interferon and ribavirin and the double stranded nucleic acid molecule. In one embodiment, the siNA molecule or double stranded nucleic acid molecule of the invention is formulated as a composition described in U.S. Provisional patent application No. 60/678,531 and in related U.S. Provisional patent application No. 60/703,946, filed Jul. 29, 2005, and U.S. Provisional patent application No. 60/737,024, filed Nov. 15, 2005 (Vargeese et al.).

In one embodiment, in addition to the methods described herein or in combination with the methods described herein, a subject is further treated with palivizumab, RespiGam, A-60444, or other antiviral compounds and fusion inhibitors that may be used to treat RSV infection, alone, or in combination with other therapeutic modalities.

In one embodiment, the invention features a method for treating or preventing Respiratory syncytial virus (RSV) infection in a subject, comprising administering to the subject PEG Interferon in combination with a chemically synthesized double stranded nucleic acid molecule; wherein (a) the double stranded nucleic acid molecule comprises a sense strand and an antisense strand; (b) each strand of the double stranded nucleic acid molecule is 15 to 28 nucleotides in length; (c) at least 15 nucleotides of the sense strand are complementary to the antisense strand (d) the antisense strand of the double stranded nucleic acid molecule has complementarity to a Respiratory syncytial virus (RSV) RSV target RNA; (e) at least 20% of the internal nucleotides of each strand of the double stranded nucleic acid molecule are modified nucleosides having a chemical modification; and (f) at least two of the chemical modifications are different from each other, and wherein the PEG Interferon and the double stranded nucleic acid molecule are administered under conditions suitable for reducing or inhibiting the level of Respiratory syncytial virus (RSV) in the subject compared to a subject not treated with the PEG Interferon and the double stranded nucleic acid molecule. In one embodiment, the siNA molecule or double stranded nucleic acid molecule of the invention is formulated as a composition described in U.S. Provisional patent application No. 60/678,531 and in related U.S. Provisional patent application No. 60/703,946, filed Jul. 29, 2005, and U.S. Provisional patent application No. 60/737,024, filed Nov. 15, 2005 (Vargeese et al.).

In one embodiment, the invention features a method for treating or preventing Respiratory syncytial virus (RSV) infection in a subject, comprising administering to the subject ribavirin in combination with a chemically synthesized double stranded nucleic acid molecule; wherein (a) the double stranded nucleic acid molecule comprises a sense strand and an antisense strand; (b) each strand of the double stranded nucleic acid molecule is 15 to 28 nucleotides in length; (c) at least 15 nucleotides of the sense strand are complementary to the antisense strand (d) the antisense strand of the double stranded nucleic acid molecule has complementarity to a Respiratory syncytial virus (RSV) RSV target RNA; (e) at least 20% of the internal nucleotides of each strand of the double stranded nucleic acid molecule are modified nucleosides having a chemical modification; and (f) at least two of the chemical modifications are different from each other, and wherein the ribavirin and the double stranded nucleic acid molecule are administered under conditions suitable for reducing or inhibiting the level of Respiratory syncytial virus (RSV) in the subject compared to a subject not treated with the ribavirin and the double stranded nucleic acid molecule. In one embodiment, the siNA molecule or double stranded nucleic acid molecule of the invention is formulated as a composition described in U.S. Provisional patent application No. 60/678,531 and in related U.S. Provisional patent application No. 60/703,946, filed Jul. 29, 2005, and U.S. Provisional patent application No. 60/737,024, filed Nov. 15, 2005 (Vargeese et al.).

In one embodiment, the invention features a method for treating or preventing Respiratory syncytial virus (RSV) infection in a subject, comprising administering to the subject PEG Interferon and ribavirin in combination with a chemically synthesized double stranded nucleic acid molecule; wherein (a) the double stranded nucleic acid molecule comprises a sense strand and an antisense strand; (b) each strand of the double stranded nucleic acid molecule is 15 to 28 nucleotides in length; (c) at least 15 nucleotides of the sense strand are complementary to the antisense strand (d) the antisense strand of the double stranded nucleic acid molecule has complementarity to a Respiratory syncytial virus (RSV) RSV target RNA; (e) at least 20% of the internal nucleotides of each strand of the double stranded nucleic acid molecule are modified nucleosides having a chemical modification; and (f) at least two of the chemical modifications are different from each other, and wherein the PEG Interferon and ribavirin and the double stranded nucleic acid molecule are administered under conditions suitable for reducing or inhibiting the level of Respiratory syncytial virus (RSV) in the subject compared to a subject not treated with the PEG Interferon and ribavirin and the double stranded nucleic acid molecule. In one embodiment, the siNA molecule or double stranded nucleic acid molecule of the invention is formulated as a composition described in U.S. Provisional patent application No. 60/678,531 and in related U.S. Provisional patent application No. 60/703,946, filed Jul. 29, 2005, and U.S. Provisional patent application No. 60/737,024, filed Nov. 15, 2005 (Vargeese et al.).

In one embodiment, the invention features a method for treating or preventing Respiratory syncytial virus (RSV) infection in a subject, comprising administering to the subject PEG Interferon in combination with a chemically synthesized double stranded nucleic acid molecule; wherein (a) the double stranded nucleic acid molecule comprises a sense strand and an antisense strand; (b) each strand of the double stranded nucleic acid molecule is 15 to 28 nucleotides in length; (c) at least 15 nucleotides of the sense strand are complementary to the antisense strand (d) the antisense strand of the double stranded nucleic acid molecule has complementarity to a Respiratory syncytial virus (RSV) RSV target RNA; (e) at least 20% of the internal nucleotides of each strand of the double stranded nucleic acid molecule are modified nucleosides having a sugar modification; and (f) at least two of the sugar modifications are different from each other, and wherein the PEG Interferon and the double stranded nucleic acid molecule are administered under conditions suitable for reducing or inhibiting the level of Respiratory syncytial virus (RSV) in the subject compared to a subject not treated with the PEG Interferon and the double stranded nucleic acid molecule. In one embodiment, the siNA molecule or double stranded nucleic acid molecule of the invention is formulated as a composition described in U.S. Provisional patent application No. 60/678,531 and in related U.S. Provisional patent application No. 60/703,946, filed Jul. 29, 2005, and U.S. Provisional patent application No. 60/737,024, filed Nov. 15, 2005 (Vargeese et al.).

In one embodiment, the invention features a method for treating or preventing Respiratory syncytial virus (RSV) infection in a subject, comprising administering to the subject ribavirin in combination with a chemically synthesized double stranded nucleic acid molecule; wherein (a) the double stranded nucleic acid molecule comprises a sense strand and an antisense strand; (b) each strand of the double stranded nucleic acid molecule is 15 to 28 nucleotides in length; (c) at least 15 nucleotides of the sense strand are complementary to the antisense strand (d) the antisense strand of the double stranded nucleic acid molecule has complementarity to a Respiratory syncytial virus (RSV) RSV target RNA; (e) at least 20% of the internal nucleotides of each strand of the double stranded nucleic acid molecule are modified nucleosides having a sugar modification; and (f) at least two of the sugar modifications are different from each other, and wherein the ribavirin and the double stranded nucleic acid molecule are administered under conditions suitable for reducing or inhibiting the level of Respiratory syncytial virus (RSV) in the subject compared to a subject not treated with the ribavirin and the double stranded nucleic acid molecule. In one embodiment, the siNA molecule or double stranded nucleic acid molecule of the invention is formulated as a composition described in U.S. Provisional patent application No. 60/678,531 and in related U.S. Provisional patent application No. 60/703,946, filed Jul. 29, 2005, and U.S. Provisional patent application No. 60/737,024, filed Nov. 15, 2005 (Vargeese et al.).

In one embodiment, the invention features a method for treating or preventing Respiratory syncytial virus (RSV) infection in a subject, comprising administering to the subject PEG Interferon and ribavirin in combination with a chemically synthesized double stranded nucleic acid molecule; wherein (a) the double stranded nucleic acid molecule comprises a sense strand and an antisense strand; (b) each strand of the double stranded nucleic acid molecule is 15 to 28 nucleotides in length; (c) at least 15 nucleotides of the sense strand are complementary to the antisense strand (d) the antisense strand of the double stranded nucleic acid molecule has complementarity to a Respiratory syncytial virus (RSV) RSV target RNA; (e) at least 20% of the internal nucleotides of each strand of the double stranded nucleic acid molecule are modified nucleosides having a sugar modification; and (f) at least two of the sugar modifications are different from each other, and wherein the PEG Interferon and ribavirin and the double stranded nucleic acid molecule are administered under conditions suitable for reducing or inhibiting the level of Respiratory syncytial virus (RSV) in the subject compared to a subject not treated with the PEG Interferon and ribavirin and the double stranded nucleic acid molecule. In one embodiment, the siNA molecule or double stranded nucleic acid molecule of the invention is formulated as a composition described in U.S. Provisional patent application No. 60/678,531 and in related U.S. Provisional patent application No.

60/703,946, filed Jul. 29, 2005, and U.S. Provisional patent application No. 60/737,024, filed Nov. 15, 2005 (Vargeese et al.).

In any of the above method for treating or preventing respiratory syncytial virus (RSV) infection in a subject, the treatment is combined with administration of a corticosteroid composition as is generally recognized in the art, including Triamcinolone acetonide, methylprednisolone, and dexamethasone.

In any of the above method for treating or preventing respiratory syncytial virus (RSV) infection in a subject, the treatment is combined with administration of a beta-2 agonist composition as is generally recognized in the art, including for example, albuterol or albuterol sulfate.

In one embodiment, the invention features a composition comprising PEG Interferon and one or more double stranded nucleic acid molecules or siNA molecules of the invention in a pharmaceutically acceptable carrier or diluent. In another embodiment, the invention features a composition comprising PEG Interferon, ribavirin, Vertex VX-950, Actilon (CPG 10101), and/or Isatoribine (TLR-7 agonist) and one or more double stranded nucleic acid molecules or siNA molecules of the invention in a pharmaceutically acceptable carrier or diluent.

In one embodiment, a method of treatment of the invention features administration of a double stranded nucleic acid molecule of the invention in combination with one or more other therapeutic modalities, including Interferon (e.g., Interferon-alpha, or PEG interferon such as PEG-Intron, Rebetol, Rebetron, or Pegasys), ribavirin, Vertex VX-950, Actilon (CPG 10101), or Isatoribine (TLR-7 agonist). In another embodiment, such combination therapies can be utilized in any of the embodiments herein.

In any of the methods of treatment of the invention, the siNA can be administered to the subject as a course of treatment, for example administration at various time intervals, such as once per day over the course of treatment, once every two days over the course of treatment, once every three days over the course of treatment, once every four days over the course of treatment, once every five days over the course of treatment, once every six days over the course of treatment, once per week over the course of treatment, once every other week over the course of treatment, once per month over the course of treatment, etc. In one embodiment, the course of treatment is once every 1, 2, 3, 4, 5, 6, 7, 8, 9, or 10 weeks. In one embodiment, the course of treatment is from about one to about 52 weeks or longer (e.g., indefinitely). In one embodiment, the course of treatment is from about one to about 48 months or longer (e.g., indefinitely).

In one embodiment, a course of treatment involves an initial course of treatment, such as once every 1, 2, 3, 4, 5, 6, 7, 8, 9, 10 or more weeks for a fixed interval (e.g., 1×, 2×, 3×, 4×, 5×, 6×, 7×, 8×, 9×, 10× or more) followed by a maintenance course of treatment, such as once every 4, 6, 8, 10, 15, 20, 25, 30, 35, 40, or more weeks for an additional fixed interval (e.g., 1×, 2×, 3×, 4×, 5×, 6×, 7×, 8×, 9×, 10× or more).

In any of the methods of treatment of the invention, the siNA can be administered to the subject systemically as described herein or otherwise known in the art, either alone as a monotherapy or in combination with additional therapies described herein or as are known in the art. Systemic administration can include, for example, pulmonary (inhalation, nebulization etc.) intravenous, subcutaneous, intramuscular, catheterization, nasopharangeal, transdermal, or gastrointestinal administration as is generally known in the art.

In one embodiment, in any of the methods of treatment or prevention of the invention, the siNA can be administered to the subject locally or to local tissues as described herein or otherwise known in the art, either alone as a monotherapy or in combination with additional therapies as are known in the art. Local administration can include, for example, inhalation, nebulization, catheterization, implantation, direct injection, dermal/transdermal application, stenting, ear/eye drops, or portal vein administration to relevant tissues, or any other local administration technique, method or procedure, as is generally known in the art.

In another embodiment, the invention features a method of modulating the expression of more than one RSV target gene in a subject or organism comprising contacting the subject or organism with one or more siNA molecules of the invention under conditions suitable to modulate (e.g., inhibit) the expression of the RSV target genes in the subject or organism.

The siNA molecules of the invention can be designed to down regulate or inhibit target gene expression through RNAi targeting of a variety of nucleic acid molecules. In one embodiment, the siNA molecules of the invention are used to target various DNA corresponding to a target gene, for example via heterochromatic silencing or transcriptional inhibition. In one embodiment, the siNA molecules of the invention are used to target various RNAs corresponding to a target gene, for example via RNA target cleavage or translational inhibition. Non-limiting examples of such RNAs include messenger RNA (mRNA), non-coding RNA (ncRNA) or regulatory elements (see for example Mattick, 2005, *Science,* 309, 1527-1528 and Clayerie, 2005, *Science,* 309, 1529-1530) which includes miRNA and other small RNAs, alternate RNA splice variants of target gene(s), post-transcriptionally modified RNA of target gene(s), pre-mRNA of target gene(s), and/or RNA templates. If alternate splicing produces a family of transcripts that are distinguished by usage of appropriate exons, the instant invention can be used to inhibit gene expression through the appropriate exons to specifically inhibit or to distinguish among the functions of gene family members. For example, a protein that contains an alternatively spliced transmembrane domain can be expressed in both membrane bound and secreted forms. Use of the invention to target the exon containing the transmembrane domain can be used to determine the functional consequences of pharmaceutical targeting of membrane bound as opposed to the secreted form of the protein. Non-limiting examples of applications of the invention relating to targeting these RNA molecules include therapeutic pharmaceutical applications, cosmetic applications, veterinary applications, pharmaceutical discovery applications, molecular diagnostic and gene function applications, and gene mapping, for example using single nucleotide polymorphism mapping with siNA molecules of the invention. Such applications can be implemented using known gene sequences or from partial sequences available from an expressed sequence tag (EST).

In another embodiment, the siNA molecules of the invention are used to target conserved sequences corresponding to a gene family or gene families such as RSV family genes (e.g., all known RSV strains, groups of related RSV strains, or groups of divergent RSV strains). As such, siNA molecules targeting multiple RSV targets can provide increased therapeutic effect. In addition, siNA can be used to characterize pathways of gene function in a variety of applications. For example, the present invention can be used to inhibit the activity of target gene(s) in a pathway to determine the function of uncharacterized gene(s) in gene function analysis, mRNA function analysis, or translational analysis. The invention can be used to determine potential target gene pathways involved in various diseases and conditions toward pharmaceutical development. The invention can be used to under-stand pathways of gene expression involved in, for example proliferative diseases, disorders and conditions.

In addition, siNA can be used to characterize pathways of gene function in a variety of applications. For example, the present invention can be used to inhibit the activity of target gene(s) in a pathway to determine the function of uncharacterized gene(s) in gene function analysis, mRNA function analysis, or translational analysis. The invention can be used to determine potential target gene pathways involved in various diseases and conditions toward pharmaceutical development.

In one embodiment, siNA molecule(s) and/or methods of the invention are used to down regulate the expression of gene(s) that encode RNA referred to by Genbank Accession, for example, target genes encoding RNA sequence(s) referred to herein by Genbank Accession number, for example, Genbank Accession Nos. shown herein (e.g. in Table I) and in U.S. Ser. No. 10/923,536 and PCT/US03/05028, both incorporated by reference herein.

In one embodiment, the invention features a method comprising: (a) generating a library of siNA constructs having a predetermined complexity; and (b) assaying the siNA constructs of (a) above, under conditions suitable to determine RNAi target sites within the target RNA sequence. In one embodiment, the siNA molecules of (a) have strands of a fixed length, for example, about 23 nucleotides in length. In another embodiment, the siNA molecules of (a) are of differing length, for example having strands of about 15 to about 30 (e.g., about 15, 16, 17, 18, 19, 20, 21, 22, 23, 24, 25, 26, 27, 28, 29, or 30) nucleotides in length. In one embodiment, the assay can comprise a reconstituted in vitro siNA assay as described herein. In another embodiment, the assay can comprise a cell culture system in which target RNA is expressed. In another embodiment, fragments of target RNA are analyzed for detectable levels of cleavage, for example by gel electrophoresis, northern blot analysis, or RNAse protection assays, to determine the most suitable target site(s) within the target RNA sequence. The target RNA sequence can be obtained as is known in the art, for example, by cloning and/or transcription for in vitro systems, and by cellular expression in in vivo systems.

In one embodiment, the invention features a method comprising: (a) generating a randomized library of siNA constructs having a predetermined complexity, such as of $4^N$, where N represents the number of base paired nucleotides in each of the siNA construct strands (eg. for a siNA construct having 21 nucleotide sense and antisense strands with 19 base pairs, the complexity would be $4^{19}$); and (b) assaying the siNA constructs of (a) above, under conditions suitable to determine RNAi target sites within the target RNA sequence. In another embodiment, the siNA molecules of (a) have strands of a fixed length, for example about 23 nucleotides in length. In yet another embodiment, the siNA molecules of (a) are of differing length, for example having strands of about 15 to about 30 (e.g., about 15, 16, 17, 18, 19, 20, 21, 22, 23, 24, 25, 26, 27, 28, 29, or 30) nucleotides in length. In one embodiment, the assay can comprise a reconstituted in vitro siNA assay as described in Example 6 herein. In another embodiment, the assay can comprise a cell culture system in which target RNA is expressed. In another embodiment, fragments of target RNA are analyzed for detectable levels of cleavage, for example, by gel electrophoresis, northern blot analysis, or RNAse protection assays, to determine the most suitable target site(s) within the target RNA sequence. The target RNA sequence can be obtained as is known in the art, for example, by cloning and/or transcription for in vitro systems, and by cellular expression in in vivo systems.

In another embodiment, the invention features a method comprising: (a) analyzing the sequence of a RNA target encoded by a target gene; (b) synthesizing one or more sets of siNA molecules having sequence complementary to one or more regions of the RNA of (a); and (c) assaying the siNA molecules of (b) under conditions suitable to determine RNAi targets within the target RNA sequence. In one embodiment, the siNA molecules of (b) have strands of a fixed length, for example about 23 nucleotides in length. In another embodiment, the siNA molecules of (b) are of differing length, for example having strands of about 15 to about 30 (e.g., about 15, 16, 17, 18, 19, 20, 21, 22, 23, 24, 25, 26, 27, 28, 29, or 30) nucleotides in length. In one embodiment, the assay can comprise a reconstituted in vitro siNA assay as described herein. In another embodiment, the assay can comprise a cell culture system in which target RNA is expressed. Fragments of target RNA are analyzed for detectable levels of cleavage, for example by gel electrophoresis, northern blot analysis, or RNAse protection assays, to determine the most suitable target site(s) within the target RNA sequence. The target RNA sequence can be obtained as is known in the art, for example, by cloning and/or transcription for in vitro systems, and by expression in in vivo systems.

By "target site" is meant a sequence within a target RNA that is "targeted" for cleavage mediated by a siNA construct which contains sequences within its antisense region that are complementary to the target sequence.

By "detectable level of cleavage" is meant cleavage of target RNA (and formation of cleaved product RNAs) to an extent sufficient to discern cleavage products above the background of RNAs produced by random degradation of the target RNA. Production of cleavage products from 1-5% of the target RNA is sufficient to detect above the background for most methods of detection.

In one embodiment, the invention features a composition comprising a siNA molecule of the invention, which can be chemically-modified, in a pharmaceutically acceptable carrier or diluent. In another embodiment, the invention features a pharmaceutical composition comprising siNA molecules of the invention, which can be chemically-modified, targeting one or more genes in a pharmaceutically acceptable carrier or diluent. In another embodiment, the invention features a method for diagnosing a disease, trait, or condition in a subject comprising administering to the subject a composition of the invention under conditions suitable for the diagnosis of the disease, trait, or condition in the subject. In another embodiment, the invention features a method for treating or preventing a disease, trait, or condition, such as hearing loss, deafness, tinnitus, and/or motion and balance disorders in a subject, comprising administering to the subject a composition of the invention under conditions suitable for the treatment or prevention of the disease, trait, or condition in the subject, alone or in conjunction with one or more other therapeutic compounds.

In another embodiment, the invention features a method for validating a target gene target, comprising: (a) synthesizing a siNA molecule of the invention, which can be chemically-modified, wherein one of the siNA strands includes a sequence complementary to RNA of a target gene; (b) introducing the siNA molecule into a cell, tissue, subject, or organism under conditions suitable for modulating expression of the target gene in the cell, tissue, subject, or organism; and (c) determining the function of the gene by assaying for any phenotypic change in the cell, tissue, subject, or organism.

In another embodiment, the invention features a method for validating a target comprising: (a) synthesizing a siNA molecule of the invention, which can be chemically-modified, wherein one of the siNA strands includes a sequence complementary to RNA of a target gene; (b) introducing the siNA molecule into a biological system under conditions suitable for modulating expression of the target gene in the biological system; and (c) determining the function of the gene by assaying for any phenotypic change in the biological system.

By "biological system" is meant, material, in a purified or unpurified form, from biological sources, including but not limited to human or animal, wherein the system comprises the components required for RNAi activity. The term "biological system" includes, for example, a cell, tissue, subject, or organism, or extract thereof. The term biological system also includes reconstituted RNAi systems that can be used in an in vitro setting.

By "phenotypic change" is meant any detectable change to a cell that occurs in response to contact or treatment with a nucleic acid molecule of the invention (e.g., siNA). Such detectable changes include, but are not limited to, changes in shape, size, proliferation, motility, protein expression or RNA expression or other physical or chemical changes as can be assayed by methods known in the art. The detectable change can also include expression of reporter genes/molecules such as Green Florescent Protein (GFP) or various tags that are used to identify an expressed protein or any other cellular component that can be assayed.

In one embodiment, the invention features a kit containing a siNA molecule of the invention, which can be chemically-modified, that can be used to modulate the expression of a target gene in a biological system, including, for example, in a cell, tissue, subject, or organism. In another embodiment, the invention features a kit containing more than one siNA molecule of the invention, which can be chemically-modified, that can be used to modulate the expression of more than one target gene in a biological system, including, for example, in a cell, tissue, subject, or organism.

In one embodiment, the invention features a cell containing one or more siNA molecules of the invention, which can be chemically-modified. In another embodiment, the cell containing a siNA molecule of the invention is a mammalian cell. In yet another embodiment, the cell containing a siNA molecule of the invention is a human cell.

In one embodiment, the synthesis of a siNA molecule of the invention, which can be chemically-modified, comprises: (a) synthesis of two complementary strands of the siNA molecule; (b) annealing the two complementary strands together under conditions suitable to obtain a double-stranded siNA molecule. In another embodiment, synthesis of the two complementary strands of the siNA molecule is by solid phase oligonucleotide synthesis. In yet another embodiment, synthesis of the two complementary strands of the siNA molecule is by solid phase tandem oligonucleotide synthesis.

In one embodiment, the invention features a method for synthesizing a siNA duplex molecule comprising: (a) synthesizing a first oligonucleotide sequence strand of the siNA molecule, wherein the first oligonucleotide sequence strand comprises a cleavable linker molecule that can be used as a scaffold for the synthesis of the second oligonucleotide sequence strand of the siNA; (b) synthesizing the second oligonucleotide sequence strand of siNA on the scaffold of the first oligonucleotide sequence strand, wherein the second oligonucleotide sequence strand further comprises a chemical moiety than can be used to purify the siNA duplex; (c) cleaving the linker molecule of (a) under conditions suitable for the two siNA oligonucleotide strands to hybridize and form a stable duplex; and (d) purifying the siNA duplex utilizing the chemical moiety of the second oligonucleotide sequence strand. In one embodiment, cleavage of the linker molecule in (c) above takes place during deprotection of the oligonucleotide, for example, under hydrolysis conditions using an alkylamine base such as methylamine. In one embodiment, the method of synthesis comprises solid phase synthesis on a solid support such as controlled pore glass (CPG) or polystyrene, wherein the first sequence of (a) is synthesized on a cleavable linker, such as a succinyl linker, using the solid support as a scaffold. The cleavable linker in (a) used as a scaffold for synthesizing the second strand can comprise similar reactivity as the solid support derivatized linker, such that cleavage of the solid support derivatized linker and the cleavable linker of (a) takes place concomitantly. In another embodiment, the chemical moiety of (b) that can be used to isolate the attached oligonucleotide sequence comprises a trityl group, for example a dimethoxytrityl group, which can be employed in a trityl-on synthesis strategy as described herein. In yet another embodiment, the chemical moiety, such as a dimethoxytrityl group, is removed during purification, for example, using acidic conditions.

In a further embodiment, the method for siNA synthesis is a solution phase synthesis or hybrid phase synthesis wherein both strands of the siNA duplex are synthesized in tandem using a cleavable linker attached to the first sequence which acts a scaffold for synthesis of the second sequence. Cleavage of the linker under conditions suitable for hybridization of the separate siNA sequence strands results in formation of the double-stranded siNA molecule.

In another embodiment, the invention features a method for synthesizing a siNA duplex molecule comprising: (a) synthesizing one oligonucleotide sequence strand of the siNA molecule, wherein the sequence comprises a cleavable linker molecule that can be used as a scaffold for the synthesis of another oligonucleotide sequence; (b) synthesizing a second oligonucleotide sequence having complementarity to the first sequence strand on the scaffold of (a), wherein the second sequence comprises the other strand of the double-stranded siNA molecule and wherein the second sequence further comprises a chemical moiety than can be used to isolate the attached oligonucleotide sequence; (c) purifying the product of (b) utilizing the chemical moiety of the second oligonucleotide sequence strand under conditions suitable for isolating the full-length sequence comprising both siNA oligonucleotide strands connected by the cleavable linker and under conditions suitable for the two siNA oligonucleotide strands to hybridize and form a stable duplex. In one embodiment, cleavage of the linker molecule in (c) above takes place during deprotection of the oligonucleotide, for example, under hydrolysis conditions. In another embodiment, cleavage of the linker molecule in (c) above takes place after deprotection of the oligonucleotide. In another embodiment, the method of synthesis comprises solid phase synthesis on a solid support such as controlled pore glass (CPG) or polystyrene, wherein the first sequence of (a) is synthesized on a cleavable linker, such as a succinyl linker, using the solid support as a scaffold. The cleavable linker in (a) used as a scaffold for synthesizing the second strand can comprise similar reactivity or differing reactivity as the solid support derivatized linker, such that cleavage of the solid support derivatized linker and the cleavable linker of (a) takes place either concomitantly or sequentially. In one embodiment, the chemical moiety of (b) that can be used to isolate the attached oligonucleotide sequence comprises a trityl group, for example a dimethoxytrityl group.

In another embodiment, the invention features a method for making a double-stranded siNA molecule in a single synthetic process comprising: (a) synthesizing an oligonucleotide having a first and a second sequence, wherein the first sequence is complementary to the second sequence, and the first oligonucleotide sequence is linked to the second sequence via a cleavable linker, and wherein a terminal 5'-protecting group, for example, a 5'-O-dimethoxytrityl group (5'-O-DMT) remains on the oligonucleotide having the second sequence; (b) deprotecting the oligonucleotide whereby the deprotection results in the cleavage of the linker joining the two oligonucleotide sequences; and (c) purifying the product of (b) under conditions suitable for isolating the double-stranded siNA molecule, for example using a trityl-on synthesis strategy as described herein.

In another embodiment, the method of synthesis of siNA molecules of the invention comprises the teachings of Scaringe et al., U.S. Pat. Nos. 5,889,136; 6,008,400; and 6,111,086, incorporated by reference herein in their entirety.

In one embodiment, the invention features siNA constructs that mediate RNAi against a target polynucleotide (e.g., RNA or DNA target), wherein the siNA construct comprises one or more chemical modifications, for example, one or more chemical modifications having any of Formulae I-VII or any combination thereof that increases the nuclease resistance of the siNA construct.

In another embodiment, the invention features a method for generating siNA molecules with increased nuclease resistance comprising (a) introducing nucleotides having any of Formula I-VII or any combination thereof into a siNA molecule, and (b) assaying the siNA molecule of step (a) under conditions suitable for isolating siNA molecules having increased nuclease resistance.

In one embodiment, the invention features siNA constructs that mediate RNAi against a target polynucleotide, wherein the siNA construct comprises one or more chemical modifications described herein that modulates the binding affinity between the sense and antisense strands of the siNA construct.

In another embodiment, the invention features a method for generating siNA molecules with increased binding affinity between the sense and antisense strands of the siNA molecule comprising (a) introducing nucleotides having any of Formula I-VII or any combination thereof into a siNA molecule, and (b) assaying the siNA molecule of step (a) under conditions suitable for isolating siNA molecules having increased binding affinity between the sense and antisense strands of the siNA molecule.

In one embodiment, the invention features siNA constructs that mediate RNAi against a target polynucleotide, wherein the siNA construct comprises one or more chemical modifications described herein that modulates the binding affinity between the antisense strand of the siNA construct and a complementary target RNA sequence within a cell.

In one embodiment, the invention features siNA constructs that mediate RNAi against a target polynucleotide, wherein the siNA construct comprises one or more chemical modifications described herein that modulates the binding affinity between the antisense strand of the siNA construct and a complementary target DNA sequence within a cell.

In another embodiment, the invention features a method for generating siNA molecules with increased binding affinity between the antisense strand of the siNA molecule and a complementary target RNA sequence comprising (a) introducing nucleotides having any of Formula I-VII or any combination thereof into a siNA molecule, and (b) assaying the siNA molecule of step (a) under conditions suitable for isolating siNA molecules having increased binding affinity between the antisense strand of the siNA molecule and a complementary target RNA sequence.

In another embodiment, the invention features a method for generating siNA molecules with increased binding affinity between the antisense strand of the siNA molecule and a complementary target DNA sequence comprising (a) introducing nucleotides having any of Formula I-VII or any combination thereof into a siNA molecule, and (b) assaying the siNA molecule of step (a) under conditions suitable for isolating siNA molecules having increased binding affinity between the antisense strand of the siNA molecule and a complementary target DNA sequence.

In one embodiment, the invention features siNA constructs that mediate RNAi against a target polynucleotide, wherein the siNA construct comprises one or more chemical modifications described herein that modulate the polymerase activity of a cellular polymerase capable of generating additional endogenous siNA molecules having sequence homology to the chemically-modified siNA construct.

In another embodiment, the invention features a method for generating siNA molecules capable of mediating increased polymerase activity of a cellular polymerase capable of generating additional endogenous siNA molecules having sequence homology to a chemically-modified siNA molecule comprising (a) introducing nucleotides having any of Formula I-VII or any combination thereof into a siNA molecule, and (b) assaying the siNA molecule of step (a) under conditions suitable for isolating siNA molecules capable of mediating increased polymerase activity of a cellular polymerase capable of generating additional endogenous siNA molecules having sequence homology to the chemically-modified siNA molecule.

In one embodiment, the invention features chemically-modified siNA constructs that mediate RNAi against a target polynucleotide in a cell, wherein the chemical modifications do not significantly effect the interaction of siNA with a target RNA molecule, DNA molecule and/or proteins or other factors that are essential for RNAi in a manner that would decrease the efficacy of RNAi mediated by such siNA constructs.

In another embodiment, the invention features a method for generating siNA molecules with improved RNAi specificity against polynucleotide targets comprising (a) introducing nucleotides having any of Formula I-VII or any combination thereof into a siNA molecule, and (b) assaying the siNA molecule of step (a) under conditions suitable for isolating siNA molecules having improved RNAi specificity. In one embodiment, improved specificity comprises having reduced off target effects compared to an unmodified siNA molecule. For example, introduction of terminal cap moieties at the 3'-end, 5'-end, or both 3' and 5'-ends of the sense strand or region of a siNA molecule of the invention can direct the siNA to have improved specificity by preventing the sense strand or sense region from acting as a template for RNAi activity against a corresponding target having complementarity to the sense strand or sense region.

In another embodiment, the invention features a method for generating siNA molecules with improved RNAi activity against a target polynucleotide comprising (a) introducing nucleotides having any of Formula I-VII or any combination thereof into a siNA molecule, and (b) assaying the siNA molecule of step (a) under conditions suitable for isolating siNA molecules having improved RNAi activity.

In yet another embodiment, the invention features a method for generating siNA molecules with improved RNAi activity against a target RNA comprising (a) introducing nucleotides having any of Formula I-VII or any combination thereof into a siNA molecule, and (b) assaying the siNA molecule of step (a) under conditions suitable for isolating siNA molecules having improved RNAi activity against the target RNA.

In yet another embodiment, the invention features a method for generating siNA molecules with improved RNAi activity against a target DNA comprising (a) introducing nucleotides having any of Formula I-VII or any combination thereof into a siNA molecule, and (b) assaying the siNA molecule of step (a) under conditions suitable for isolating siNA molecules having improved RNAi activity against the target DNA.

In one embodiment, the invention features siNA constructs that mediate RNAi against a target polynucleotide, wherein the siNA construct comprises one or more chemical modifications described herein that modulates the cellular uptake of the siNA construct, such as cholesterol conjugation of the siNA.

In another embodiment, the invention features a method for generating siNA molecules against a target polynucleotide with improved cellular uptake comprising (a) introducing nucleotides having any of Formula I-VII or any combination thereof into a siNA molecule, and (b) assaying the siNA molecule of step (a) under conditions suitable for isolating siNA molecules having improved cellular uptake.

In one embodiment, the invention features siNA constructs that mediate RNAi against a target polynucleotide, wherein the siNA construct comprises one or more chemical modifications described herein that increases the bioavailability of the siNA construct, for example, by attaching polymeric conjugates such as polyethyleneglycol or equivalent conjugates that improve the pharmacokinetics of the siNA construct, or by attaching conjugates that target specific tissue types or cell types in vivo. Non-limiting examples of such conjugates are described in Vargeese et al., U.S. Ser. No. 10/201,394 incorporated by reference herein.

In one embodiment, the invention features a method for generating siNA molecules of the invention with improved bioavailability comprising (a) introducing a conjugate into the structure of a siNA molecule, and (b) assaying the siNA molecule of step (a) under conditions suitable for isolating siNA molecules having improved bioavailability. Such conjugates can include ligands for cellular receptors, such as peptides derived from naturally occurring protein ligands; protein localization sequences, including cellular ZIP code sequences; antibodies; nucleic acid aptamers; vitamins and other co-factors, such as folate and N-acetylgalactosamine; polymers, such as polyethyleneglycol (PEG); phospholipids; cholesterol; cholesterol derivatives, polyamines, such as spermine or spermidine; and others.

In one embodiment, the invention features a double stranded short interfering nucleic acid (siNA) molecule that comprises a first nucleotide sequence complementary to a target RNA sequence or a portion thereof, and a second sequence having complementarity to said first sequence, wherein said second sequence is chemically modified in a manner that it can no longer act as a guide sequence for efficiently mediating RNA interference and/or be recognized by cellular proteins that facilitate RNAi. In one embodiment, the first nucleotide sequence of the siNA is chemically modified as described herein. In one embodiment, the first nucleotide sequence of the siNA is not modified (e.g., is all RNA).

In one embodiment, the invention features a double stranded short interfering nucleic acid (siNA) molecule that comprises a first nucleotide sequence complementary to a target RNA sequence or a portion thereof, and a second sequence having complementarity to said first sequence, wherein the second sequence is designed or modified in a manner that prevents its entry into the RNAi pathway as a guide sequence or as a sequence that is complementary to a target nucleic acid (e.g., RNA) sequence. In one embodiment, the first nucleotide sequence of the siNA is chemically modified as described herein. In one embodiment, the first nucleotide sequence of the siNA is not modified (e.g., is all RNA). Such design or modifications are expected to enhance the activity of siNA and/or improve the specificity of siNA molecules of the invention. These modifications are also expected to minimize any off-target effects and/or associated toxicity.

In one embodiment, the invention features a double stranded short interfering nucleic acid (siNA) molecule that comprises a first nucleotide sequence complementary to a target RNA sequence or a portion thereof, and a second sequence having complementarity to said first sequence, wherein said second sequence is incapable of acting as a guide sequence for mediating RNA interference. In one embodiment, the first nucleotide sequence of the siNA is chemically modified as described herein. In one embodiment, the first nucleotide sequence of the siNA is not modified (e.g., is all RNA).

In one embodiment, the invention features a double stranded short interfering nucleic acid (siNA) molecule that comprises a first nucleotide sequence complementary to a target RNA sequence or a portion thereof, and a second sequence having complementarity to said first sequence, wherein said second sequence does not have a terminal 5'-hydroxyl (5'-OH) or 5'-phosphate group.

In one embodiment, the invention features a double stranded short interfering nucleic acid (siNA) molecule that comprises a first nucleotide sequence complementary to a target RNA sequence or a portion thereof, and a second sequence having complementarity to said first sequence, wherein said second sequence comprises a terminal cap moiety at the 5'-end of said second sequence. In one embodiment, the terminal cap moiety comprises an inverted abasic, inverted deoxy abasic, inverted nucleotide moiety, a group shown in FIG. 10, an alkyl or cycloalkyl group, a heterocycle, or any other group that prevents RNAi activity in which the second sequence serves as a guide sequence or template for RNAi.

In one embodiment, the invention features a double stranded short interfering nucleic acid (siNA) molecule that comprises a first nucleotide sequence complementary to a target RNA sequence or a portion thereof, and a second sequence having complementarity to said first sequence, wherein said second sequence comprises a terminal cap moiety at the 5'-end and 3'-end of said second sequence. In one embodiment, each terminal cap moiety individually comprises an inverted abasic, inverted deoxy abasic, inverted nucleotide moiety, a group shown in FIG. 10, an alkyl or cycloalkyl group, a heterocycle, or any other group that prevents RNAi activity in which the second sequence serves as a guide sequence or template for RNAi.

In one embodiment, the invention features a method for generating siNA molecules of the invention with improved specificity for down regulating or inhibiting the expression of a target nucleic acid (e.g., a DNA or RNA such as a gene or its corresponding RNA), comprising (a) introducing one or more chemical modifications into the structure of a siNA molecule, and (b) assaying the siNA molecule of step (a) under conditions suitable for isolating siNA molecules having improved specificity. In another embodiment, the chemical modification used to improve specificity comprises terminal cap modifications at the 5'-end, 3'-end, or both 5' and 3'-ends of the siNA molecule. The terminal cap modifications can comprise, for example, structures shown in FIG. 10 (e.g. inverted deoxyabasic moieties) or any other chemical modification that renders a portion of the siNA molecule (e.g. the sense strand) incapable of mediating RNA interference against an off target nucleic acid sequence. In a non-limiting example, a siNA molecule is designed such that only the antisense sequence of the siNA molecule can serve as a guide sequence for RISC mediated degradation of a corresponding target RNA sequence. This can be accomplished by rendering the sense sequence of the siNA inactive by introducing chemical modifications to the sense strand that preclude recognition of the sense strand as a guide sequence by RNAi machinery. In one embodiment, such chemical modifications comprise any chemical group at the 5'-end of the sense strand of the siNA, or any other group that serves to render the sense strand inactive as a guide sequence for mediating RNA interference. These modifications, for example, can result in a molecule where the 5'-end of the sense strand no longer has a free 5'-hydroxyl (5'-OH) or a free 5'-phosphate group (e.g., phosphate, diphosphate, triphosphate, cyclic phosphate etc.). Non-limiting examples of such siNA constructs are described herein, such as "Stab 9/10", "Stab 7/8", "Stab 7/19", "Stab 17/22", "Stab 23/24", "Stab 24/25", and "Stab 24/26" (e.g., any siNA having Stab 7, 9, 17, 23, or 24 sense strands) chemistries and variants thereof (see Table IV) wherein the 5'-end and 3'-end of the sense strand of the siNA do not comprise a hydroxyl group or phosphate group. Herein, numeric Stab chemistries include both 2'-fluoro and 2'-OCF3 versions of the chemistries shown in Table IV. For example, "Stab 7/8" refers to both Stab 7/8 and Stab 7F/8F etc.

In one embodiment, the invention features a method for generating siNA molecules of the invention with improved specificity for down regulating or inhibiting the expression of a target nucleic acid (e.g., a DNA or RNA such as a gene or its corresponding RNA), comprising introducing one or more chemical modifications into the structure of a siNA molecule that prevent a strand or portion of the siNA molecule from acting as a template or guide sequence for RNAi activity. In one embodiment, the inactive strand or sense region of the siNA molecule is the sense strand or sense region of the siNA molecule, i.e. the strand or region of the siNA that does not have complementarity to the target nucleic acid sequence. In one embodiment, such chemical modifications comprise any chemical group at the 5'-end of the sense strand or region of the siNA that does not comprise a 5'-hydroxyl (5'-OH) or 5'-phosphate group, or any other group that serves to render the sense strand or sense region inactive as a guide sequence for mediating RNA interference. Non-limiting examples of such siNA constructs are described herein, such as "Stab 9/10", "Stab 7/8", "Stab 7/19", "Stab 17/22", "Stab 23/24", "Stab 24/25", and "Stab 24/26" (e.g., any siNA having Stab 7, 9, 17, 23, or 24 sense strands) chemistries and variants thereof (see Table IV) wherein the 5'-end and 3'-end of the sense strand of the siNA do not comprise a hydroxyl group or phosphate group. Herein, numeric Stab chemistries include both 2'-fluoro and 2'-OCF3 versions of the chemistries shown in Table IV. For example, "Stab 7/8" refers to both Stab 7/8 and Stab 7F/8F etc.

In one embodiment, the invention features a method for screening siNA molecules that are active in mediating RNA interference against a target nucleic acid sequence comprising (a) generating a plurality of unmodified siNA molecules, (b) screening the siNA molecules of step (a) under conditions suitable for isolating siNA molecules that are active in mediating RNA interference against the target nucleic acid sequence, and (c) introducing chemical modifications (e.g. chemical modifications as described herein or as otherwise known in the art) into the active siNA molecules of (b). In one embodiment, the method further comprises re-screening the chemically modified siNA molecules of step (c) under conditions suitable for isolating chemically modified siNA molecules that are active in mediating RNA interference against the target nucleic acid sequence.

In one embodiment, the invention features a method for screening chemically modified siNA molecules that are active in mediating RNA interference against a target nucleic acid sequence comprising (a) generating a plurality of chemically modified siNA molecules (e.g. siNA molecules as described herein or as otherwise known in the art), and (b) screening the siNA molecules of step (a) under conditions suitable for isolating chemically modified siNA molecules that are active in mediating RNA interference against the target nucleic acid sequence.

The term "ligand" refers to any compound or molecule, such as a drug, peptide, hormone, or neurotransmitter, that is capable of interacting with another compound, such as a receptor, either directly or indirectly. The receptor that interacts with a ligand can be present on the surface of a cell or can alternately be an intercellular receptor. Interaction of the ligand with the receptor can result in a biochemical reaction, or can simply be a physical interaction or association.

In another embodiment, the invention features a method for generating siNA molecules of the invention with improved bioavailability comprising (a) introducing an excipient formulation to a siNA molecule, and (b) assaying the siNA molecule of step (a) under conditions suitable for isolating siNA molecules having improved bioavailability. Such excipients include polymers such as cyclodextrins, lipids, cationic lipids, polyamines, phospholipids, nanoparticles, receptors, ligands, and others.

In another embodiment, the invention features a method for generating siNA molecules of the invention with improved bioavailability comprising (a) introducing nucleotides having any of Formulae I-VII or any combination thereof into a siNA molecule, and (b) assaying the siNA molecule of step (a) under conditions suitable for isolating siNA molecules having improved bioavailability.

In another embodiment, polyethylene glycol (PEG) can be covalently attached to siNA compounds of the present invention. The attached PEG can be any molecular weight, preferably from about 100 to about 50,000 daltons (Da).

The present invention can be used alone or as a component of a kit having at least one of the reagents necessary to carry out the in vitro or in vivo introduction of RNA to test samples and/or subjects. For example, preferred components of the kit include a siNA molecule of the invention and a vehicle that promotes introduction of the siNA into cells of interest as described herein (e.g., using lipids and other methods of transfection known in the art, see for example Beigelman et al, U.S. Pat. No. 6,395,713). The kit can be used for target validation, such as in determining gene function and/or activity, or in drug optimization, and in drug discovery (see for example Usman et al., U.S. Ser. No. 60/402,996). Such a kit can also include instructions to allow a user of the kit to practice the invention.

The term "short interfering nucleic acid", "siNA", "short interfering RNA", "siRNA", "short interfering nucleic acid molecule", "short interfering oligonucleotide molecule", or "chemically-modified short interfering nucleic acid molecule" as used herein refers to any nucleic acid molecule capable of inhibiting or down regulating gene expression or viral replication by mediating RNA interference "RNAi" or gene silencing in a sequence-specific manner. For example the siNA can be a double-stranded nucleic acid molecule comprising self-complementary sense and antisense regions, wherein the antisense region comprises nucleotide sequence that is complementary to nucleotide sequence in a target nucleic acid molecule or a portion thereof and the sense region having nucleotide sequence corresponding to the target nucleic acid sequence or a portion thereof. The siNA can be assembled from two separate oligonucleotides, where one strand is the sense strand and the other is the antisense strand, wherein the antisense and sense strands are self-complementary (i.e., each strand comprises nucleotide sequence that is complementary to nucleotide sequence in the other strand; such as where the antisense strand and sense strand form a duplex or double stranded structure, for example wherein the double stranded region is about 15 to about 30, e.g., about 15, 16, 17, 18, 19, 20, 21, 22, 23, 24, 25, 26, 27, 28, 29 or 30 base pairs; the antisense strand comprises nucleotide sequence that is complementary to nucleotide sequence in a target nucleic acid molecule or a portion thereof and the sense strand comprises nucleotide sequence corresponding to the target nucleic acid sequence or a portion thereof (e.g., about 15 to about 25 or more nucleotides of the siNA molecule are complementary to the target nucleic acid or a portion thereof). Alternatively, the siNA is assembled from a single oligonucleotide, where the self-complementary sense and antisense regions of the siNA are linked by means of a nucleic acid based or non-nucleic acid-based linker(s). The siNA can be a polynucleotide with a duplex, asymmetric duplex, hairpin or asymmetric hairpin secondary structure, having self-complementary sense and antisense regions, wherein the antisense region comprises nucleotide sequence that is complementary to nucleotide sequence in a separate target nucleic acid molecule or a portion thereof and the sense region having nucleotide sequence corresponding to the target nucleic acid sequence or a portion thereof. The siNA can be a circular single-stranded polynucleotide having two or more loop structures and a stem comprising self-complementary sense and antisense regions, wherein the antisense region comprises nucleotide sequence that is complementary to nucleotide sequence in a target nucleic acid molecule or a portion thereof and the sense region having nucleotide sequence corresponding to the target nucleic acid sequence or a portion thereof, and wherein the circular polynucleotide can be processed either in vivo or in vitro to generate an active siNA molecule capable of mediating RNAi. The siNA can also comprise a single stranded polynucleotide having nucleotide sequence complementary to nucleotide sequence in a target nucleic acid molecule or a portion thereof (for example, where such siNA molecule does not require the presence within the siNA molecule of nucleotide sequence corresponding to the target nucleic acid sequence or a portion thereof), wherein the single stranded polynucleotide can further comprise a terminal phosphate group, such as a 5'-phosphate (see for example Martinez et al., 2002, *Cell.*, 110, 563-574 and Schwarz et al., 2002, *Molecular Cell*, 10, 537-568), or 5',3'-diphosphate. In certain embodiments, the siNA molecule of the invention comprises separate sense and antisense sequences or regions, wherein the sense and antisense regions are covalently linked by nucleotide or non-nucleotide linkers molecules as is known in the art, or are alternately non-covalently linked by ionic interactions, hydrogen bonding, van der waals interactions, hydrophobic interactions, and/or stacking interactions. In certain embodiments, the siNA molecules of the invention comprise nucleotide sequence that is complementary to nucleotide sequence of a target gene. In another embodiment, the siNA molecule of the invention interacts with nucleotide sequence of a target gene in a manner that causes inhibition of expression of the target gene. As used herein, siNA molecules need not be limited to those molecules containing only RNA, but further encompasses chemically-modified nucleotides and non-nucleotides. In certain embodiments, the short interfering nucleic acid molecules of the invention lack 2'-hydroxy (2'-OH) containing nucleotides. Applicant describes in certain embodiments short interfering nucleic acids that do not require the presence of nucleotides having a 2'-hydroxy group for mediating RNAi and as such, short interfering nucleic acid molecules of the invention optionally do not include any ribonucleotides (e.g., nucleotides having a 2'-OH group). Such siNA molecules that do not require the presence of ribonucleotides within the siNA molecule to support RNAi can however have an attached linker or linkers or other attached or associated groups, moieties, or chains containing one or more nucleotides with 2'-OH groups. Optionally, siNA molecules can comprise ribonucleotides at about 5, 10, 20, 30, 40, or 50% of the nucleotide positions. The modified short interfering nucleic acid molecules of the invention can also be referred to as short interfering modified oligonucleotides "siMON." As used herein, the term siNA is meant to be equivalent to other terms used to describe nucleic acid molecules that are capable of mediating sequence specific RNAi, for example short interfering RNA (siRNA), double-stranded RNA (dsRNA), micro-RNA (miRNA), short hairpin RNA (shRNA), short interfering oligonucleotide, short interfering nucleic acid, short interfering modified oligonucleotide, chemically-modified siRNA, post-transcriptional gene silencing RNA (ptgsRNA), and others. Non limiting examples of siNA molecules of the invention are shown in FIGS. 4-6, and Tables II and III herein. Such siNA molecules are distinct from other nucleic acid technologies known in the art that mediate inhibition of gene expression, such as ribozymes, antisense, triplex forming, aptamer, 2,5-A chimera, or decoy oligonucleotides.

By "RNA interference" or "RNAi" is meant a biological process of inhibiting or down regulating gene expression in a cell as is generally known in the art and which is mediated by short interfering nucleic acid molecules, see for example Zamore and Haley, 2005, *Science*, 309, 1519-1524; Vaughn and Martienssen, 2005, *Science*, 309, 1525-1526; Zamore et al., 2000, *Cell*, 101, 25-33; Bass, 2001, *Nature*, 411, 428-429; Elbashir et al., 2001, *Nature*, 411, 494-498; and Kreutzer et al., International PCT Publication No. WO 00/44895; Zernicka-Goetz et al., International PCT Publication No. WO 01/36646; Fire, International PCT Publication No. WO 99/32619; Plaetinck et al., International PCT Publication No. WO 00/01846; Mello and Fire, International PCT Publication No. WO 01/29058; Deschamps-Depaillette, International PCT Publication No. WO 99/07409; and Li et al., International PCT Publication No. WO 00/44914; Allshire, 2002, *Science*, 297, 1818-1819; Volpe et al., 2002, *Science*, 297, 1833-1837; Jenuwein, 2002, *Science*, 297, 2215-2218; and Hall et al., 2002, *Science*, 297, 2232-2237; Hutvagner and Zamore, 2002, *Science*, 297, 2056-60; McManus et al., 2002, *RNA*, 8, 842-850; Reinhart et al., 2002, *Gene & Dev.*, 16, 1616-1626; and Reinhart & Bartel, 2002, *Science*, 297, 1831). In addition, as used herein, the term RNAi is meant to be equivalent to other terms used to describe sequence specific RNA interference, such as post transcriptional gene silencing, translational inhibition, transcriptional inhibition, or epigenetics. For example, siNA molecules of the invention can be used to epigenetically silence genes at both the post-transcriptional level or the pre-transcriptional level. In a non-limiting example, epigenetic modulation of gene expression by siNA molecules of the invention can result from siNA mediated modification of chromatin structure or methylation patterns to alter gene expression (see, for example, Verdel et al., 2004, *Science*, 303, 672-676; Pal-Bhadra et al., 2004, *Science*, 303, 669-672; Allshire, 2002, *Science*, 297, 1818-1819; Volpe et al., 2002, *Science*, 297, 1833-1837; Jenuwein, 2002, *Science*, 297, 2215-2218; and Hall et al., 2002, *Science*, 297, 2232-2237). In another non-limiting example, modulation of gene expression by siNA molecules of the invention can result from siNA mediated cleavage of RNA (either coding or non-coding RNA) via RISC, or alternately, translational inhibition as is known in the art. In another embodiment, modulation of gene expression by siNA molecules of the invention can result from transcriptional inhibition (see for example Janowski et al., 2005, *Nature Chemical Biology*, 1, 216-222).

In one embodiment, a siNA molecule of the invention is a duplex forming oligonucleotide "DFO", (see for example FIGS. 14-15 and Vaish et al., U.S. Ser. No. 10/727,780 filed Dec. 3, 2003 and International PCT Application No. US04/16390, filed May 24, 2004).

In one embodiment, a siNA molecule of the invention is a multifunctional siNA, (see for example FIGS. 16-28 and Jadhav et al., U.S. Ser. No. 60/543,480 filed Feb. 10, 2004 and International PCT Application No. US04/16390, filed May 24, 2004). In one embodiment, the multifunctional siNA of the invention can comprise sequence targeting, for example, two or more regions of RSV RNA (see for example target sequences in Tables II and III). In one embodiment, the multifunctional siNA of the invention can comprise sequence targeting RSV RNA and one or more cellular targets involved in the RSV lifecycle, such as cellular receptors, cell surface molecules, cellular enzymes, cellular transcription factors, and/or cytokines, second messengers, and cellular accessory molecules including, but not limited to, La antigen (see for example Costa-Mattioli et al., 2004, *Mol Cell Biol.*, 24, 6861-70, e.g., Genbank Accession No. NM_003142) (e.g., interferon regulatory factors (IRFs; e.g., Genbank Accession No. AF082503.1); cellular PKR protein kinase (e.g., Genbank Accession No. XM_002661.7); human eukaryotic initiation factors 2B (elF2Bgamma; e.g., Genbank Accession No. AF256223, and/or elF2gamma; e.g., Genbank Accession No. NM_006874.1); human DEAD Box protein (DDX3; e.g., Genbank Accession No. XM_018021.2); and cellular proteins that bind to the poly(U) tract of the RSV 3'-UTR, such as polypyrimidine tract-binding protein (e.g., Genbank Accession Nos. NM_031991.1 and XM_042972.3).

By "asymmetric hairpin" as used herein is meant a linear siNA molecule comprising an antisense region, a loop portion that can comprise nucleotides or non-nucleotides, and a sense region that comprises fewer nucleotides than the antisense region to the extent that the sense region has enough complementary nucleotides to base pair with the antisense region and form a duplex with loop. For example, an asymmetric hairpin siNA molecule of the invention can comprise an antisense region having length sufficient to mediate RNAi in a cell or in vitro system (e.g. about 15 to about 30, or about 15, 16, 17, 18, 19, 20, 21, 22, 23, 24, 25, 26, 27, 28, 29, or 30 nucleotides) and a loop region comprising about 4 to about 12 (e.g., about 4, 5, 6, 7, 8, 9, 10, 11, or 12) nucleotides, and a sense region having about 3 to about 25 (e.g., about 3, 4, 5, 6, 7, 8, 9, 10, 11, 12, 13, 14, 15, 16, 17, 18, 19, 20, 21, 22, 23, 24, or 25) nucleotides that are complementary to the antisense region. The asymmetric hairpin siNA molecule can also comprise a 5'-terminal phosphate group that can be chemically modified. The loop portion of the asymmetric hairpin siNA molecule can comprise nucleotides, non-nucleotides, linker molecules, or conjugate molecules as described herein.

By "asymmetric duplex" as used herein is meant a siNA molecule having two separate strands comprising a sense region and an antisense region, wherein the sense region comprises fewer nucleotides than the antisense region to the extent that the sense region has enough complementary nucleotides to base pair with the antisense region and form a duplex. For example, an asymmetric duplex siNA molecule of the invention can comprise an antisense region having length sufficient to mediate RNAi in a cell or in vitro system (e.g., about 15 to about 30, or about 15, 16, 17, 18, 19, 20, 21, 22, 23, 24, 25, 26, 27, 28, 29, or 30 nucleotides) and a sense region having about 3 to about 25 (e.g., about 3, 4, 5, 6, 7, 8, 9, 10, 11, 12, 13, 14, 15, 16, 17, 18, 19, 20, 21, 22, 23, 24, or 25) nucleotides that are complementary to the antisense region.

By "modulate" is meant that the expression of the gene, or level of a RNA molecule or equivalent RNA molecules encoding one or more proteins or protein subunits, or activity of one or more proteins or protein subunits is up regulated or down regulated, such that expression, level, or activity is greater than or less than that observed in the absence of the modulator. For example, the term "modulate" can mean "inhibit," but the use of the word "modulate" is not limited to this definition.

By "inhibit", "down-regulate", or "reduce", it is meant that the expression of the gene, or level of RNA molecules or equivalent RNA molecules encoding one or more proteins or protein subunits, or activity of one or more proteins or protein subunits, is reduced below that observed in the absence of the nucleic acid molecules (e.g., siNA) of the invention. In one embodiment, inhibition, down-regulation or reduction with an siNA molecule is below that level observed in the presence of an inactive or attenuated molecule.

In another embodiment, inhibition, down-regulation, or reduction with siNA molecules is below that level observed in the presence of, for example, an siNA molecule with scrambled sequence or with mismatches. In another embodiment, inhibition, down-regulation, or reduction of gene expression with a nucleic acid molecule of the instant invention is greater in the presence of the nucleic acid molecule than in its absence. In one embodiment, inhibition, down regulation, or reduction of gene expression is associated with post transcriptional silencing, such as RNAi mediated cleavage of a target nucleic acid molecule (e.g. RNA) or inhibition of translation. In one embodiment, inhibition, down regulation, or reduction of gene expression is associated with pre-transcriptional silencing, such as by alterations in DNA methylation patterns and DNA chromatin structure.

By "up-regulate", or "promote", it is meant that the expression of the gene, or level of RNA molecules or equivalent RNA molecules encoding one or more proteins or protein subunits, or activity of one or more proteins or protein subunits, is increased above that observed in the absence of the nucleic acid molecules (e.g., siNA) of the invention. In one embodiment, up-regulation or promotion of gene expression with an siNA molecule is above that level observed in the presence of an inactive or attenuated molecule. In another embodiment, up-regulation or promotion of gene expression with siNA molecules is above that level observed in the presence of, for example, an siNA molecule with scrambled sequence or with mismatches. In another embodiment, up-regulation or promotion of gene expression with a nucleic acid molecule of the instant invention is greater in the presence of the nucleic acid molecule than in its absence. In one embodiment, up-regulation or promotion of gene expression is associated with inhibition of RNA mediated gene silencing, such as RNAi mediated cleavage or silencing of a coding or non-coding RNA target that down regulates, inhibits, or silences the expression of the gene of interest to be up-regulated. The down regulation of gene expression can, for example, be induced by a coding RNA or its encoded protein, such as through negative feedback or antagonistic effects.

The down regulation of gene expression can, for example, be induced by a non-coding RNA having regulatory control over a gene of interest, for example by silencing expression of the gene via translational inhibition, chromatin structure, methylation, RISC mediated RNA cleavage, or translational inhibition. As such, inhibition or down regulation of targets that down regulate, suppress, or silence a gene of interest can be used to up-regulate or promote expression of the gene of interest toward therapeutic use.

By "gene", or "target gene" or "target DNA", is meant a nucleic acid that encodes an RNA, for example, nucleic acid sequences including, but not limited to, structural genes encoding a polypeptide. A gene or target gene can also encode a functional RNA (FRNA) or non-coding RNA (ncRNA), such as small temporal RNA (stRNA), micro RNA (miRNA), small nuclear RNA (snRNA), short interfering RNA (siRNA), small nucleolar RNA (snRNA), ribosomal RNA (rRNA), transfer RNA (tRNA) and precursor RNAs thereof. Such non-coding RNAs can serve as target nucleic acid molecules for siNA mediated RNA interference in modulating the activity of FRNA or ncRNA involved in functional or regulatory cellular processes. Abberant FRNA or ncRNA activity leading to disease can therefore be modulated by siNA molecules of the invention. siNA molecules targeting FRNA and ncRNA can also be used to manipulate or alter the genotype or phenotype of a subject, organism or cell, by intervening in cellular processes such as genetic imprinting, transcription, translation, or nucleic acid processing (e.g., transamination, methylation etc.). The target gene can be a gene derived from a cell, an endogenous gene, a transgene, or exogenous genes such as genes of a pathogen, for example a virus, which is present in the cell after infection thereof. The cell containing the target gene can be derived from or contained in any organism, for example a plant, animal, protozoan, virus, bacterium, or fungus. Non-limiting examples of plants include monocots, dicots, or gymnosperms. Non-limiting examples of animals include vertebrates or invertebrates. Non-limiting examples of fungi include molds or yeasts. For a review, see for example Snyder and Gerstein, 2003, *Science*, 300, 258-260.

By "non-canonical base pair" is meant any non-Watson Crick base pair, such as mismatches and/or wobble base pairs, including flipped mismatches, single hydrogen bond mismatches, trans-type mismatches, triple base interactions, and quadruple base interactions. Non-limiting examples of such non-canonical base pairs include, but are not limited to, AC reverse Hoogsteen, AC wobble, AU reverse Hoogsteen, GU wobble, AA N7 amino, CC 2-carbonyl-amino(H1)-N-3-amino(H2), GA sheared, UC 4-carbonyl-amino, UU iminocarbonyl, AC reverse wobble, AU Hoogsteen, AU reverse Watson Crick, CG reverse Watson Crick, GC N3-amino-amino N3, AA N1-amino symmetric, AA N7-amino symmetric, GA N7-N1 amino-carbonyl, GA+carbonyl-amino N7-N1, GG N1-carbonyl symmetric, GG N3-amino symmetric, CC carbonyl-amino symmetric, CC N3-amino symmetric, UU 2-carbonyl-imino symmetric, UU 4-carbonyl-imino symmetric, AA amino-N3, AA N1-amino, AC amino 2-carbonyl, AC N3-amino, AC N7-amino, AU amino-4-carbonyl, AU N1-imino, AU N3-imino, AU N7-imino, CC carbonyl-amino, GA amino-N1, GA amino-N7, GA carbonyl-amino, GA N3-amino, GC amino-N3, GC carbonyl-amino, GC N3-amino, GC N7-amino, GG amino-N7, GG carbonyl-imino, GG N7-amino, GU amino-2-carbonyl, GU carbonyl-imino, GU imino-2-carbonyl, GU N7-imino, psiU imino-2-carbonyl, UC 4-carbonyl-amino, UC imino-carbonyl, UU imino-4-carbonyl, AC C2-H—N3, GA carbonyl-C2-H, UU imino-4-carbonyl 2 carbonyl-C5-H, AC amino(A) N3(C)-carbonyl, GC imino amino-carbonyl, Gpsi imino-2-carbonyl amino-2-carbonyl, and GU imino amino-2-carbonyl base pairs.

By "RSV" as used herein is meant, any respiratory syncytial virus or RSV protein, peptide, or polypeptide having RSV activity, such as encoded by RSV Genbank Accession Nos. shown in Table I. The term RSV also refers to nucleic acid sequences encoding any RSV protein, peptide, or polypeptide having RSV activity (e.g., any of protein such as nucleopretein (N), large (L) and phosphoproteins (P), matrix (M), fusion (F), glycoprotein (G), NS1 and 2 non-structural proteins, including small hydrophobic (SH) and M2 proteins). The term "RSV" is also meant to include other RSV encoding sequence, such as other RSV isoforms, mutant RSV genes, splice variants of RSV genes, and RSV gene polymorphisms. In one embodiment, the term RSV as used herein refers to cellular or host proteins or polynucleotides encoding such proteins or that are otherwise involved in RSV infection and/or replication.

By "target" as used herein is meant, any target protein, peptide, or polypeptide, such as encoded by Genbank Accession Nos. herein and in U.S. Ser. No. 10/923,536 and PCT/US03/05028, both incorporated by reference herein. The term "target" also refers to nucleic acid sequences or target polynucleotide sequence encoding any target protein, peptide, or polypeptide, such as proteins, peptides, or polypeptides encoded by sequences having Genbank Accession Nos. shown herein or in U.S. Ser. No. 10/923,536 and PCT/US03/05028. The target of interest can include target polynucleotide sequences, such as target DNA or target RNA. The term "target" is also meant to include other sequences, such as differing isoforms, mutant target genes, splice variants of target polynucleotides, target polymorphisms, and non-coding (e.g., ncRNA, miRNA, sRNA) or other regulatory polynucleotide sequences as described herein. Therefore, in various embodiments of the invention, a double stranded nucleic acid molecule of the invention (e.g., siNA) having complementarity to a target RNA can be used to inhibit or down regulate miRNA or other ncRNA activity. In one embodiment, inhibition of miRNA or ncRNA activity can be used to down regulate or inhibit gene expression (e.g., gene targets described herein or otherwise known in the art) or viral replication (e.g., viral targets described herein or otherwise known in the art) that is dependent on miRNA or ncRNA activity. In another embodiment, inhibition of miRNA or ncRNA activity by double stranded nucleic acid molecules of the invention (e.g. siNA) having complementarity to the miRNA or ncRNA can be used to up regulate or promote target gene expression (e.g., gene targets described herein or otherwise known in the art) where the expression of such genes is down regulated, suppressed, or silenced by the miRNA or ncRNA. Such up-regulation of gene expression can be used to treat diseases and conditions associated with a loss of function or haploinsufficiency as are generally known in the art.

By "homologous sequence" is meant, a nucleotide sequence that is shared by one or more polynucleotide sequences, such as genes, gene transcripts and/or non-coding polynucleotides. For example, a homologous sequence can be a nucleotide sequence that is shared by two or more genes encoding related but different proteins, such as different members of a gene family, different protein epitopes, different protein isoforms or completely divergent genes, such as a cytokine and its corresponding receptors. A homologous sequence can be a nucleotide sequence that is shared by two or more non-coding polynucleotides, such as noncoding DNA or RNA, regulatory sequences, introns, and sites of transcriptional control or regulation. Homologous sequences can also include conserved sequence regions shared by more than one polynucleotide sequence. Homology does not need to be perfect homology (e.g., 100%), as partially homologous sequences are also contemplated by the instant invention (e.g., 99%, 98%, 97%, 96%, 95%, 94%, 93%, 92%, 91%, 90%, 89%, 88%, 87%, 86%, 85%, 84%, 83%, 82%, 81%, 80% etc.).

By "conserved sequence region" is meant, a nucleotide sequence of one or more regions in a polynucleotide does not vary significantly between generations or from one biological system, subject, or organism to another biological system, subject, or organism. The polynucleotide can include both coding and non-coding DNA and RNA.

By "sense region" is meant a nucleotide sequence of a siNA molecule having complementarity to an antisense region of the siNA molecule. In addition, the sense region of a siNA molecule can comprise a nucleic acid sequence having homology with a target nucleic acid sequence. In one embodiment, the sense region of the siNA molecule is referred to as the sense strand or passenger strand.

By "antisense region" is meant a nucleotide sequence of a siNA molecule having complementarity to a target nucleic acid sequence. In addition, the antisense region of a siNA molecule can optionally comprise a nucleic acid sequence having complementarity to a sense region of the siNA molecule. In one embodiment, the antisense region of the siNA molecule is referred to as the antisense strand or guide strand.

By "target nucleic acid" or "target polynucleotide" is meant any nucleic acid sequence whose expression or activity is to be modulated. The target nucleic acid can be DNA or RNA. In one embodiment, a target nucleic acid of the invention is target RNA or DNA.

By "complementarity" is meant that a nucleic acid can form hydrogen bond(s) with another nucleic acid sequence by either traditional Watson-Crick or other non-traditional types as described herein. In one embodiment, a double stranded nucleic acid molecule of the invention, such as an siNA molecule, wherein each strand is between 15 and 30 nucleotides in length, comprises between about 10% and about 100% (e.g., about 10%, 20%, 30%, 40%, 50%, 60%, 70%, 80%, 90%, or 100%) complementarity between the two strands of the double stranded nucleic acid molecule. In another embodiment, a double stranded nucleic acid molecule of the invention, such as an siNA molecule, where one strand is the sense strand and the other stand is the antisense strand, wherein each strand is between 15 and 30 nucleotides in length, comprises between at least about 10% and about 100% (e.g., at least about 10%, 20%, 30%, 40%, 50%, 60%, 70%, 80%, 90%, or 100%) complementarity between the nucleotide sequence in the antisense strand of the double stranded nucleic acid molecule and the nucleotide sequence of its corresponding target nucleic acid molecule, such as a target RNA or target mRNA or viral RNA. In one embodiment, a double stranded nucleic acid molecule of the invention, such as an siNA molecule, where one strand comprises nucleotide sequence that is referred to as the sense region and the other strand comprises a nucleotide sequence that is referred to as the antisense region, wherein each strand is between 15 and 30 nucleotides in length, comprises between about 10% and about 100% (e.g., about 10%, 20%, 30%, 40%, 50%, 60%, 70%, 80%, 90%, or 100%) complementarity between the sense region and the antisense region of the double stranded nucleic acid molecule. In reference to the nucleic molecules of the present invention, the binding free energy for a nucleic acid molecule with its complementary sequence is sufficient to allow the relevant function of the nucleic acid to proceed, e.g., RNAi activity. Determination of binding free energies for nucleic acid molecules is well known in the art (see, e.g., Turner et al., 1987, *CSH Symp. Quant. Biol. LII pp.* 123-133; Frier et al., 1986, *Proc. Nat. Acad. Sci. USA* 83:9373-9377; Turner et al., 1987, *J. Am. Chem. Soc.* 109:3783-3785). A percent complementarity indicates the percentage of contiguous residues in a nucleic acid molecule that can form hydrogen bonds (e.g., Watson-Crick base pairing) with a second nucleic acid sequence (e.g., 5, 6, 7, 8, 9, or 10 nucleotides out of a total of 10 nucleotides in the first oligonucleotide being based paired to a second nucleic acid sequence having 10 nucleotides represents 50%, 60%, 70%, 80%, 90%, and 100% complementary respectively). In one embodiment, a siNA molecule of the invention has perfect complementarity between the sense strand or sense region and the antisense strand or antisense region of the siNA molecule. In one embodiment, a siNA molecule of the invention is perfectly complementary to a corresponding target nucleic acid molecule. "Perfectly complementary" means that all the contiguous residues of a nucleic acid sequence will hydrogen bond with the same number of contiguous residues in a second nucleic acid sequence. In one embodiment, a siNA molecule of the invention comprises about 15 to about 30 or more (e.g., about 15, 16, 17, 18, 19, 20, 21, 22, 23, 24, 25, 26, 27, 28, 29, or 30 or more) nucleotides that are complementary to one or more target nucleic acid molecules or a portion thereof. In one embodiment, a siNA molecule of the invention has partial complementarity (i.e., less than 100% complementarity) between the sense strand or sense region and the antisense strand or antisense region of the siNA molecule or between the antisense strand or antisense region of the siNA molecule and a corresponding target nucleic acid molecule. For example, partial complementarity can include various mismatches or non-based paired nucleotides (e.g., 1, 2, 3, 4, 5 or more mismatches or non-based paired nucleotides) within the siNA structure which can result in bulges, loops, or overhangs that result between the between the sense strand or sense region and the antisense strand or antisense region of the siNA molecule or between the antisense strand or antisense region of the siNA molecule and a corresponding target nucleic acid molecule.

In one embodiment, a double stranded nucleic acid molecule of the invention, such as siNA molecule, has perfect complementarity between the sense strand or sense region and the antisense strand or antisense region of the nucleic acid molecule. In one embodiment, double stranded nucleic acid molecule of the invention, such as siNA molecule, is perfectly complementary to a corresponding target nucleic acid molecule.

In one embodiment, double stranded nucleic acid molecule of the invention, such as siNA molecule, has partial complementarity (i.e., less than 100% complementarity) between the sense strand or sense region and the antisense strand or antisense region of the double stranded nucleic acid molecule or between the antisense strand or antisense region of the nucleic acid molecule and a corresponding target nucleic acid molecule. For example, partial complementarity can include various mismatches or non-base paired nucleotides (e.g., 1, 2, 3, 4, 5 or more mismatches or non-based paired nucleotides, such as nucleotide bulges) within the double stranded nucleic acid molecule, structure which can result in bulges, loops, or overhangs that result between the sense strand or sense region and the antisense strand or antisense region of the double stranded nucleic acid molecule or between the antisense strand or antisense region of the double stranded nucleic acid molecule and a corresponding target nucleic acid molecule.

In one embodiment, double stranded nucleic acid molecule of the invention is a microRNA (miRNA). By "microRNA" or "miRNA" is meant, a small double stranded RNA that regulates the expression of target messenger RNAs either by mRNA cleavage, translational repression/inhibition or heterochromatic silencing (see for example Ambros, 2004, Nature, 431, 350-355; Bartel, 2004, Cell, 116, 281-297; Cullen, 2004, Virus Research., 102, 3-9; He et al., 2004, Nat. Rev. Genet., 5, 522-531; Ying et al., 2004, Gene, 342, 25-28; and Sethupathy et al., 2006, RNA, 12:192-197). In one embodiment, the microRNA of the invention, has partial complementarity (i.e., less than 100% complementarity) between the sense strand or sense region and the antisense strand or antisense region of the miRNA molecule or between the antisense strand or antisense region of the miRNA and a corresponding target nucleic acid molecule. For example, partial complementarity can include various mismatches or non-base paired nucleotides (e.g., 1, 2, 3, 4, 5 or more mismatches or non-based paired nucleotides, such as nucleotide bulges) within the double stranded nucleic acid molecule, structure which can result in bulges, loops, or overhangs that result between the sense strand or sense region and the antisense strand or antisense region of the miRNA or between the antisense strand or antisense region of the miRNA and a corresponding target nucleic acid molecule.

In one embodiment, the invention features nucleic acids that inhibit, down-regulate, or disrupt miRNAs that are involved in RSV infection and/or the RSV life-cycle. For example, a double stranded nucleic acid molecule of the invention (e.g., siNA) can be used to inhibit the function of a miRNA. In certain embodiments herein, the micro RNA is the target RNA in any of the embodiments herein. Double stranded nucleic acid molecules of the invention (e.g., siNA) having a antisense strand or antisense region that is complementary to a target miRNA sequence and a sense strand complementary to the antisense strand can be used to inhibit the activity of miRNAs involved in the RSV life-cycle or in RSV infection to prevent RSV activity or treat RSV infection in a cell or organism. Similarly, an single stranded nucleic acid molecule having complementary to a target miRNA sequence can be used to inhibit the activity of miRNAs involved in the RSV life-cycle or in RSV infection to prevent RSV activity or treat RSV infection in a cell or organism (see for example Zamore et al., US 2005/0227256 and Tuschl et al., US 2005/0182005 both incorporated by reference herein in their entirety; Zamore et al., 2005, Science, 309: 1519-24; Czech, 2006, NEJM, 354:1194-5; Krutzfeldt et al, 2005, Nature, 438:685-9).

In one embodiment, siNA molecules of the invention that down regulate or reduce target gene expression are used for treating, preventing or reducing RSV infection, respiratory distress, bronchiolitis and/or pneumonia in a subject or organism as described herein or otherwise known in the art.

In one embodiment of the present invention, each sequence of a siNA molecule of the invention is independently about 15 to about 30 nucleotides in length, in specific embodiments about 15, 16, 17, 18, 19, 20, 21, 22, 23, 24, 25, 26, 27, 28, 29, or 30 nucleotides in length. In another embodiment, the siNA duplexes of the invention independently comprise about 15 to about 30 base pairs (e.g., about 15, 16, 17, 18, 19, 20, 21, 22, 23, 24, 25, 26, 27, 28, 29, or 30). In another embodiment, one or more strands of the siNA molecule of the invention independently comprises about 15 to about 30 nucleotides (e.g., about 15, 16, 17, 18, 19, 20, 21, 22, 23, 24, 25, 26, 27, 28, 29, or 30) that are complementary to a target nucleic acid molecule. In yet another embodiment, siNA molecules of the invention comprising hairpin or circular structures are about 35 to about 55 (e.g., about 35, 40, 45, 50 or 55) nucleotides in length, or about 38 to about 44 (e.g., about 38, 39, 40, 41, 42, 43, or 44) nucleotides in length and comprising about 15 to about 25 (e.g., about 15, 16, 17, 18, 19, 20, 21, 22, 23, 24, or 25) base pairs. Exemplary siNA molecules of the invention are shown in Tables II and III and/or FIGS. 4-5.

As used herein "cell" is used in its usual biological sense, and does not refer to an entire multicellular organism, e.g., specifically does not refer to a human. The cell can be present in an organism, e.g., birds, plants and mammals such as humans, cows, sheep, apes, monkeys, swine, dogs, and cats. The cell can be prokaryotic (e.g., bacterial cell) or eukaryotic (e.g., mammalian or plant cell). The cell can be of somatic or germ line origin, totipotent or pluripotent, dividing or non-dividing. The cell can also be derived from or can comprise a gamete or embryo, a stem cell, or a fully differentiated cell.

The siNA molecules of the invention are added directly, or can be complexed with cationic lipids, packaged within liposomes, or otherwise delivered to target cells or tissues. The nucleic acid or nucleic acid complexes can be locally administered to relevant tissues ex vivo, or in vivo through local delivery to the lung, with or without their incorporation in biopolymers. In particular embodiments, the nucleic acid molecules of the invention comprise sequences shown in Tables II-III and/or FIGS. 4-5. Examples of such nucleic acid molecules consist essentially of sequences defined in these tables and figures. Furthermore, the chemically modified constructs described in Table IV can be applied to any siNA sequence of the invention.

In another aspect, the invention provides mammalian cells containing one or more siNA molecules of this invention. The one or more siNA molecules can independently be targeted to the same or different sites.

By "RNA" is meant a molecule comprising at least one ribonucleotide residue. By "ribonucleotide" is meant a nucleotide with a hydroxyl group at the 2' position of a β-D-ribofuranose moiety. The terms include double-stranded RNA, single-stranded RNA, isolated RNA such as partially purified RNA, essentially pure RNA, synthetic RNA, recombinantly produced RNA, as well as altered RNA that differs from naturally occurring RNA by the addition, deletion, substitution and/or alteration of one or more nucleotides. Such alterations can include addition of non-nucleotide material, such as to the end(s) of the siNA or internally, for example at one or more nucleotides of the RNA. Nucleotides in the RNA molecules of the instant invention can also comprise non-standard nucleotides, such as non-naturally occurring nucleotides or chemically synthesized nucleotides or deoxynucleotides. These altered RNAs can be referred to as analogs or analogs of naturally-occurring RNA.

By "subject" is meant an organism, which is a donor or recipient of explanted cells or the cells themselves. "Subject" also refers to an organism to which the nucleic acid molecules of the invention can be administered. A subject can be a mammal or mammalian cells, including a human or human cells. In one embodiment, the subject is an infant (e.g., subjects that are less than 1 month old, or 1, 2, 3, 4, 5, 6, 7, 8, 9 10, 11, or 12 months old). In one embodiment, the subject is a toddler (e.g., 1, 2, 3, 4, 5 or 6 years old). In one embodiment, the subject is a senior (e.g., anyone over the age of about 65 years of age).

By "chemical modification" as used herein is meant any modification of chemical structure of the nucleotides that differs from nucleotides of native siRNA or RNA. The term "chemical modification" encompasses the addition, substitution, or modification of native siRNA or RNA nucleosides and nucleotides with modified nucleosides and modified nucleotides as described herein or as is otherwise known in the art. Non-limiting examples of such chemical modifications include without limitation phosphorothioate internucleotide linkages, 2'-deoxyribonucleotides, 2'-O-methyl ribonucleotides, 2'-deoxy-2'-fluoro ribonucleotides, 4'-thio ribonucleotides, 2'-O-trifluoromethyl nucleotides, 2'-O-ethyl-trifluoromethoxy nucleotides, 2'-O-difluoromethoxy-ethoxy nucleotides (see for example U.S. Ser. No. 10/981,966 filed Nov. 5, 2004, incorporated by reference herein), "universal base" nucleotides, "acyclic" nucleotides, 5-C-methyl nucleotides, terminal glyceryl and/or inverted deoxy abasic residue incorporation, or a modification having any of Formulae I-VII herein. In one embodiment, the nucleic acid molecules of the invention (e.g, dsRNA, siNA etc.) are partially modified (e.g., about 5%, 10,%, 15%, 20%, 25%, 30%, 35%, 40%, 45%, 50%, 55%, 60%, 65%, 70%, 75%, 80%, 85%, 90%, or 95% modified) with chemical modifications. In another embodiment, the nucleic acid molecules of the invention (e.g, dsRNA, siNA etc.) are completely modified (e.g., about 100% modified) with chemical modifications.

The term "phosphorothioate" as used herein refers to an internucleotide linkage having Formula I, wherein Z and/or W comprise a sulfur atom. Hence, the term phosphorothioate refers to both phosphorothioate and phosphorodithioate internucleotide linkages.

The term "phosphonoacetate" as used herein refers to an internucleotide linkage having Formula I, wherein Z and/or W comprise an acetyl or protected acetyl group.

The term "thiophosphonoacetate" as used herein refers to an internucleotide linkage having Formula I, wherein Z comprises an acetyl or protected acetyl group and W comprises a sulfur atom or alternately W comprises an acetyl or protected acetyl group and Z comprises a sulfur atom.

The term "universal base" as used herein refers to nucleotide base analogs that form base pairs with each of the natural DNA/RNA bases with little discrimination between them. Non-limiting examples of universal bases include C-phenyl, C-naphthyl and other aromatic derivatives, inosine, azole carboxamides, and nitroazole derivatives such as 3-nitropyrrole, 4-nitroindole, 5-nitroindole, and 6-nitroindole as known in the art (see for example Loakes, 2001, Nucleic Acids Research, 29, 2437-2447).

The term "acyclic nucleotide" as used herein refers to any nucleotide having an acyclic ribose sugar, for example where any of the ribose carbons (C1, C2, C3, C4, or C5), are independently or in combination absent from the nucleotide.

The nucleic acid molecules of the instant invention, individually, or in combination or in conjunction with other drugs, can be used to for preventing or treating diseases, disorders, conditions, and traits described herein or otherwise known in the art, in a subject or organism.

In one embodiment, the siNA molecules of the invention can be administered to a subject or can be administered to other appropriate cells evident to those skilled in the art, individually or in combination with one or more drugs under conditions suitable for the treatment.

In a further embodiment, the siNA molecules can be used in combination with other known treatments to prevent or treat RSV infection, respiratory distress, bronchiolitis and/or pneumonia in a subject or organism. For example, the described molecules could be used in combination with one or more known compounds, treatments, or procedures to prevent or treat diseases, disorders, conditions, and traits described herein in a subject or organism as are known in the art.

In one embodiment, the invention features an expression vector comprising a nucleic acid sequence encoding at least one siNA molecule of the invention, in a manner which allows expression of the siNA molecule. For example, the vector can contain sequence(s) encoding both strands of a siNA molecule comprising a duplex. The vector can also contain sequence(s) encoding a single nucleic acid molecule that is self-complementary and thus forms a siNA molecule. Non-limiting examples of such expression vectors are described in Paul et al., 2002, Nature Biotechnology, 19, 505; Miyagishi and Taira, 2002, Nature Biotechnology, 19, 497; Lee et al., 2002, Nature Biotechnology, 19, 500; and Novina et al., 2002, Nature Medicine, advance online publication doi: 10.1038/nm725.

In another embodiment, the invention features a mammalian cell, for example, a human cell, including an expression vector of the invention.

In yet another embodiment, the expression vector of the invention comprises a sequence for a siNA molecule having complementarity to a RNA molecule referred to by a Genbank Accession numbers, for example Genbank Accession Nos. shown herein or in U.S. Ser. No. 10/923,536 and PCT/US03/05028, both incorporated by reference herein.

In one embodiment, an expression vector of the invention comprises a nucleic acid sequence encoding two or more siNA molecules, which can be the same or different.

In another aspect of the invention, siNA molecules that interact with target RNA molecules and down-regulate gene encoding target RNA molecules (for example target RNA molecules referred to by Genbank Accession numbers herein) are expressed from transcription units inserted into DNA or RNA vectors. The recombinant vectors can be DNA plasmids or viral vectors. siNA expressing viral vectors can be constructed based on, but not limited to, adeno-associated virus, retrovirus, adenovirus, or alphavirus. The recombinant vectors capable of expressing the siNA molecules can be delivered as described herein, and persist in target cells. Alternatively, viral vectors can be used that provide for transient expression of siNA molecules. Such vectors can be repeatedly administered as necessary. Once expressed, the siNA molecules bind and down-regulate gene function or expression via RNA interference (RNAi). Delivery of siNA expressing vectors can be systemic, such as by intravenous or intramuscular administration, by administration to target cells ex-planted from a subject followed by reintroduction into the subject, or by any other means that would allow for introduction into the desired target cell.

By "vectors" is meant any nucleic acid- and/or viral-based technique used to deliver a desired nucleic acid.

Other features and advantages of the invention will be apparent from the following description of the preferred embodiments thereof, and from the claims.

BRIEF DESCRIPTION OF THE DRAWINGS

FIG. 1 shows a non-limiting example of a scheme for the synthesis of siNA molecules. The complementary siNA sequence strands, strand 1 and strand 2, are synthesized in tandem and are connected by a cleavable linkage, such as a nucleotide succinate or abasic succinate, which can be the same or different from the cleavable linker used for solid phase synthesis on a solid support. The synthesis can be either solid phase or solution phase, in the example shown, the synthesis is a solid phase synthesis. The synthesis is performed such that a protecting group, such as a dimethoxytrityl group, remains intact on the terminal nucleotide of the tandem oligonucleotide. Upon cleavage and deprotection of the oligonucleotide, the two siNA strands spontaneously hybridize to form a siNA duplex, which allows the purification of the duplex by utilizing the properties of the terminal protecting group, for example by applying a trityl on purification method wherein only duplexes/oligonucleotides with the terminal protecting group are isolated.

FIG. 4A: The sense strand comprises 21 nucleotides wherein the two terminal 3'-nucleotides are optionally base paired and wherein all nucleotides present are ribonucleotides except for (N N) nucleotides, which can comprise ribonucleotides, deoxynucleotides, universal bases, or other chemical modifications described herein. The antisense strand comprises 21 nucleotides, optionally having a 3'-terminal glyceryl moiety wherein the two terminal 3'-nucleotides are optionally complementary to the target RNA sequence, and wherein all nucleotides present are ribonucleotides except for (N N) nucleotides, which can comprise ribonucleotides, deoxynucleotides, universal bases, or other chemical modifications described herein. A modified internucleotide linkage, such as a phosphorothioate, phosphorodithioate or other modified internucleotide linkage as described herein, shown as "s", optionally connects the (N N) nucleotides in the antisense strand.

FIG. 4B: The sense strand comprises 21 nucleotides wherein the two terminal 3'-nucleotides are optionally base paired and wherein all pyrimidine nucleotides that may be present are 2'deoxy-2'-fluoro modified nucleotides and all purine nucleotides that may be present are 2'-O-methyl modified nucleotides except for (N N) nucleotides, which can comprise ribonucleotides, deoxynucleotides, universal bases, or other chemical modifications described herein. The antisense strand comprises 21 nucleotides, optionally having a 3'-terminal glyceryl moiety and wherein the two terminal 3'-nucleotides are optionally complementary to the target RNA sequence, and wherein all pyrimidine nucleotides that may be present are 2'-deoxy-2'-fluoro modified nucleotides and all purine nucleotides that may be present are 2'-O-methyl modified nucleotides except for (N N) nucleotides, which can comprise ribonucleotides, deoxynucleotides, universal bases, or other chemical modifications described herein. A modified internucleotide linkage, such as a phosphorothioate, phosphorodithioate or other modified internucleotide linkage as described herein, shown as "s", optionally connects the (N N) nucleotides in the sense and antisense strand.

FIG. 4C: The sense strand comprises 21 nucleotides having 5'- and 3'-terminal cap moieties wherein the two terminal 3'-nucleotides are optionally base paired and wherein all pyrimidine nucleotides that may be present are 2'-O-methyl or 2'-deoxy-2'-fluoro modified nucleotides except for (N N) nucleotides, which can comprise ribonucleotides, deoxynucleotides, universal bases, or other chemical modifications described herein. The antisense strand comprises 21 nucleotides, optionally having a 3'-terminal glyceryl moiety and wherein the two terminal 3'-nucleotides are optionally complementary to the target RNA sequence, and wherein all pyrimidine nucleotides that may be present are 2'-deoxy-2'-fluoro modified nucleotides except for (N N) nucleotides, which can comprise ribonucleotides, deoxynucleotides, universal bases, or other chemical modifications described herein. A modified internucleotide linkage, such as a phosphorothioate, phosphorodithioate or other modified internucleotide linkage as described herein, shown as "s", optionally connects the (N N) nucleotides in the antisense strand.

FIG. 4D: The sense strand comprises 21 nucleotides having 5'- and 3'-terminal cap moieties wherein the two terminal 3'-nucleotides are optionally base paired and wherein all pyrimidine nucleotides that may be present are 2'-deoxy-2'-fluoro modified nucleotides except for (N N) nucleotides, which can comprise ribonucleotides, deoxynucleotides, universal bases, or other chemical modifications described herein and wherein and all purine nucleotides that may be present are 2'-deoxy nucleotides. The antisense strand comprises 21 nucleotides, optionally having a 3'-terminal glyceryl moiety and wherein the two terminal 3'-nucleotides are optionally complementary to the target RNA sequence, wherein all pyrimidine nucleotides that may be present are 2'-deoxy-2'-fluoro modified nucleotides and all purine nucleotides that may be present are 2'-O-methyl modified nucleotides except for (N N) nucleotides, which can comprise ribonucleotides, deoxynucleotides, universal bases, or other chemical modifications described herein. A modified internucleotide linkage, such as a phosphorothioate, phosphorodithioate or other modified internucleotide linkage as described herein, shown as "s", optionally connects the (N N) nucleotides in the antisense strand.

FIG. 4E: The sense strand comprises 21 nucleotides having 5'- and 3'-terminal cap moieties wherein the two terminal 3'-nucleotides are optionally base paired and wherein all pyrimidine nucleotides that may be present are 2'-deoxy-2'-fluoro modified nucleotides except for (N N) nucleotides, which can comprise ribonucleotides, deoxynucleotides, universal bases, or other chemical modifications described herein. The antisense strand comprises 21 nucleotides, optionally having a 3'-terminal glyceryl moiety and wherein the two terminal 3'-nucleotides are optionally complementary to the target RNA sequence, and wherein all pyrimidine nucleotides that may be present are 2'-deoxy-2'-fluoro modified nucleotides and all purine nucleotides that may be present are 2'-O-methyl modified nucleotides except for (N N) nucleotides, which can comprise ribonucleotides, deoxynucleotides, universal bases, or other chemical modifications described herein. A modified internucleotide linkage, such as a phosphorothioate, phosphorodithioate or other modified internucleotide linkage as described herein, shown as "s", optionally connects the (N N) nucleotides in the antisense strand.

FIG. 4F: The sense strand comprises 21 nucleotides having 5'- and 3'-terminal cap moieties wherein the two terminal 3'-nucleotides are optionally base paired and wherein all pyrimidine nucleotides that may be present are 2'-deoxy-2'-fluoro modified nucleotides except for (N N) nucleotides, which can comprise ribonucleotides, deoxynucleotides, universal bases, or other chemical modifications described herein and wherein and all purine nucleotides that may be present are 2'-deoxy nucleotides. The antisense strand comprises 21 nucleotides, optionally having a 3'-terminal glyceryl moiety and wherein the two terminal 3'-nucleotides are optionally complementary to the target RNA sequence, and having one 3'-terminal phosphorothioate internucleotide linkage and wherein all pyrimidine nucleotides that may be present are 2'-deoxy-2'-fluoro modified nucleotides and all purine nucleotides that may be present are 2'-deoxy nucleotides except for (N N) nucleotides, which can comprise ribonucleotides, deoxynucleotides, universal bases, or other chemical modifications described herein. A modified internucleotide linkage, such as a phosphorothioate, phosphorodithioate or other modified internucleotide linkage as described herein, shown as "s", optionally connects the (N N) nucleotides in the antisense strand. The antisense strand of constructs A-F comprise sequence complementary to any target nucleic acid sequence of the invention. Furthermore, when a glyceryl moiety (L) is present at the 3'-end of the antisense strand for any construct shown in FIG. 4 A-F, the modified internucleotide linkage is optional.

FIG. 6A-C shows non-limiting examples of different siNA constructs of the invention.

Figure 6A:
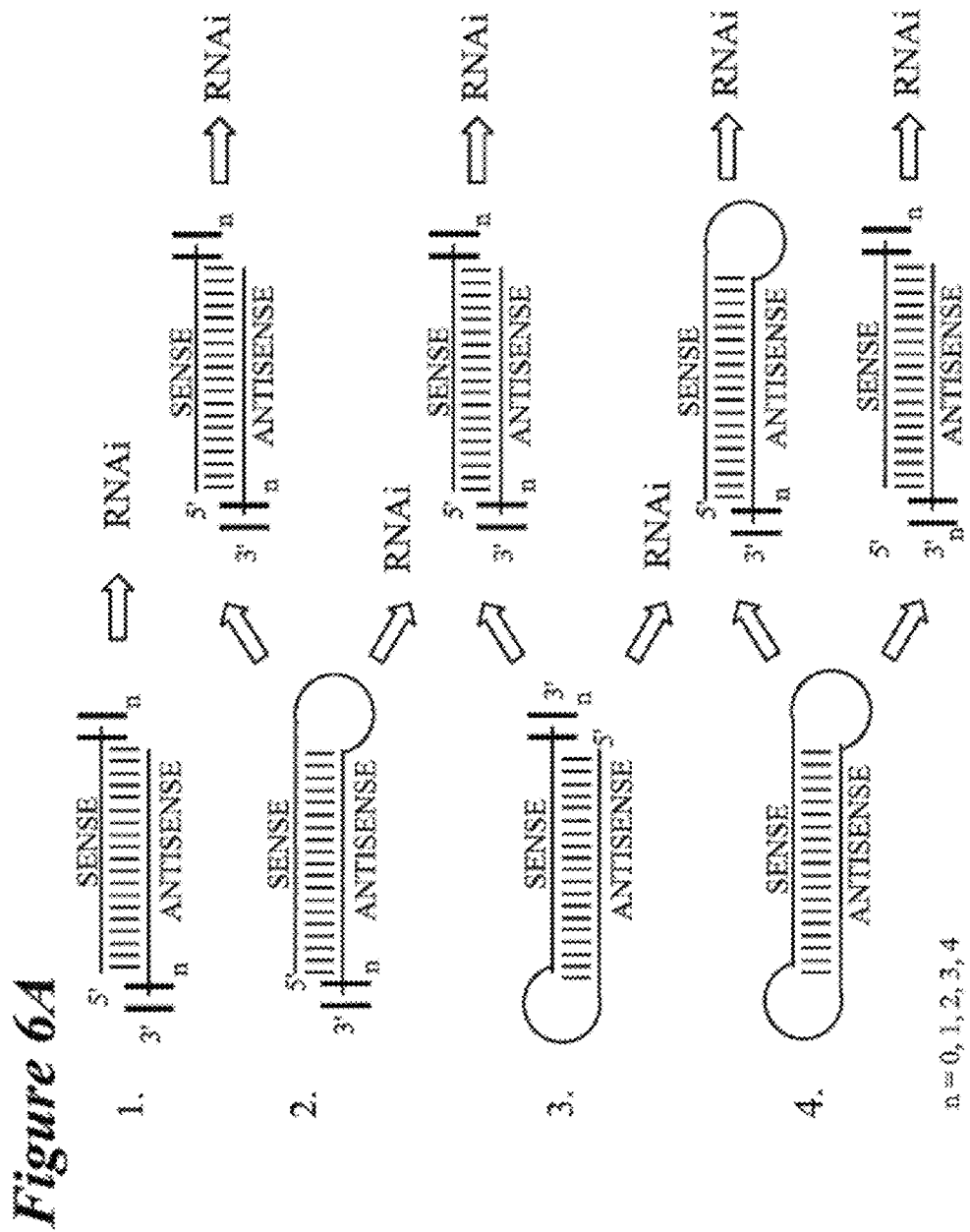

The examples shown in FIG. 6A (constructs 1, 2, and 3) have 19 representative base pairs; however, different embodiments of the invention include any number of base pairs described herein. Bracketed regions represent nucleotide overhangs, for example, comprising about 1, 2, 3, or 4 nucleotides in length, preferably about 2 nucleotides. Constructs 1 and 2 can be used independently for RNAi activity. Construct 2 can comprise a polynucleotide or non-nucleotide linker, which can optionally be designed as a biodegradable linker. In one embodiment, the loop structure shown in construct 2 can comprise a biodegradable linker that results in the formation of construct 1 in vivo and/or in vitro. In another example, construct 3 can be used to generate construct 2 under the same principle wherein a linker is used to generate the active siNA construct 2 in vivo and/or in vitro, which can optionally utilize another biodegradable linker to generate the active siNA construct 1 in vivo and/or in vitro. As such, the stability and/or activity of the siNA constructs can be modulated based on the design of the siNA construct for use in vivo or in vitro and/or in vitro.

The examples shown in FIG. 6B represent different variations of double stranded nucleic acid molecule of the invention, such as microRNA, that can include overhangs, bulges, loops, and stem-loops resulting from partial complementarity. Such motifs having bulges, loops, and stem-loops are generally characteristics of miRNA. The bulges, loops, and stem-loops can result from any degree of partial complementarity, such as mismatches or bulges of about 1, 2, 3, 4, 5, 6, 7, 8, 9, 10 or more nucleotides in one or both strands of the double stranded nucleic acid molecule of the invention.

Figure 6C:
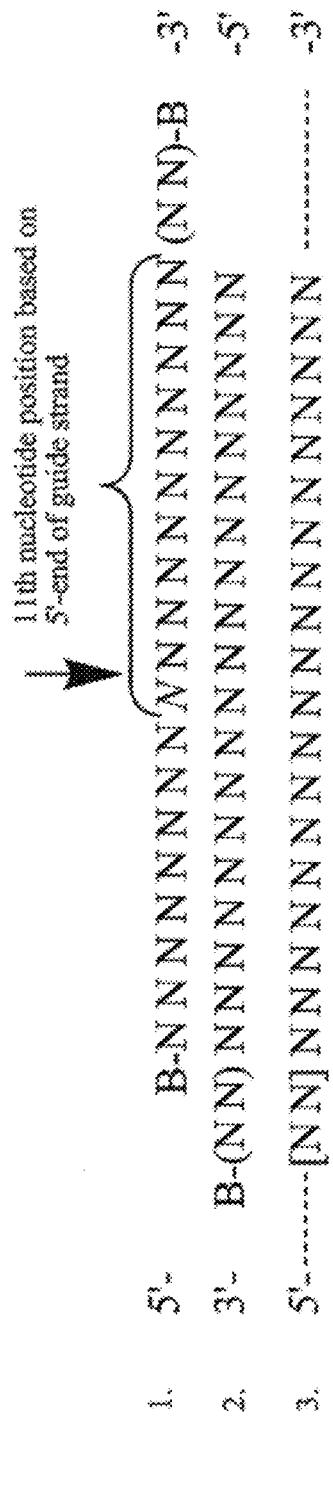

The example shown in FIG. 6C represents a model double stranded nucleic acid molecule of the invention comprising a 19 base pair duplex of two 21 nucleotide sequences having dinucleotide 3'-overhangs. The top strand (1) represents the sense strand (passenger strand), the middle strand (2) represents the antisense (guide strand), and the lower strand (3) represents a target polynucleotide sequence. The dinucleotide overhangs (NN) can comprise sequence derived from the target polynucleotide. For example, the 3'-(NN) sequence in the guide strand can be complementary to the 5'-[NN] sequence of the target polynucleotide. In addition, the 5'-(NN) sequence of the passenger strand can comprise the same sequence as the 5'-[NN] sequence of the target polynucleotide sequence. In other embodiments, the overhangs (NN) are not derived from the target polynucleotide sequence, for example where the 3'-(NN) sequence in the guide strand are not complementary to the 5'-[NN] sequence of the target polynucleotide and the 5'-(NN) sequence of the passenger strand can comprise different sequence from the 5'-[NN] sequence of the target polynucleotide sequence. In additional embodiments, any (NN) nucleotides are chemically modified, e.g., as 2'-O-methyl, 2'-deoxy-2'-fluoro, and/or other modifications herein. Furthermore, the passenger strand can comprise a ribonucleotide position N of the passenger strand. For the representative 19 base pair 21 mer duplex shown, position N can be 9 nucleotides in from the 3' end of the passenger strand. However, in duplexes of differing length, the position N is determined based on the 5'-end of the guide strand by counting 11 nucleotide positions in from the 5'-terminus of the guide strand and picking the corresponding base paired nucleotide in the passenger strand. Cleavage by Ago2 takes place between positions 10 and 11 as indicated by the arrow. In additional embodiments, there are two ribonucleotides, NN, at positions 10 and 11 based on the 5'-end of the guide strand by counting 10 and 11 nucleotide positions in from the 5'-terminus of the guide strand and picking the corresponding base paired nucleotides in the passenger strand.

Figure 7:
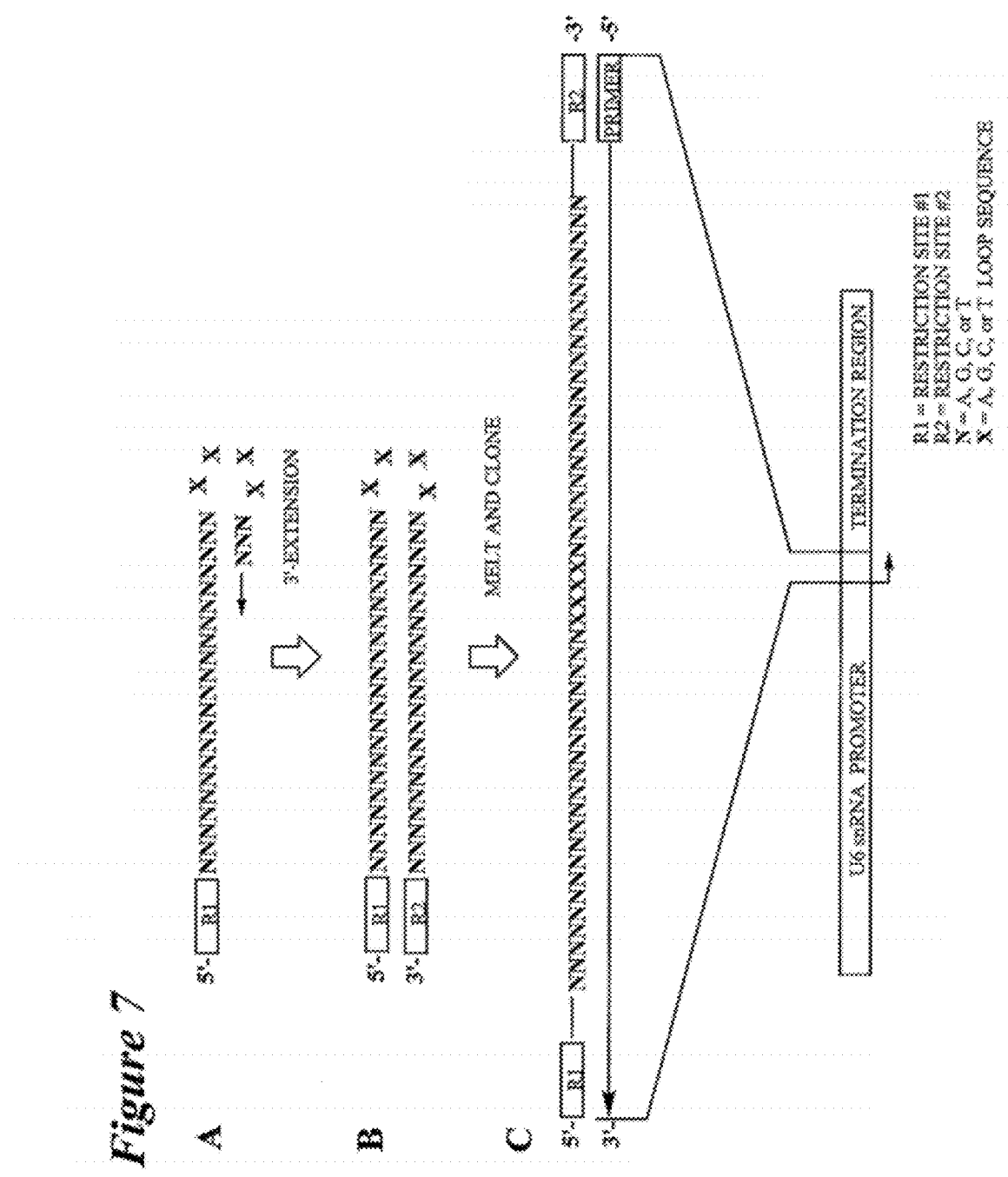

FIG. 7A-C is a diagrammatic representation of a scheme utilized in generating an expression cassette to generate siNA hairpin constructs.

FIG. 7A: A DNA oligomer is synthesized with a 5'-restriction site (R1) sequence followed by a region having sequence identical (sense region of siNA) to a predetermined target sequence, wherein the sense region comprises, for example, about 19, 20, 21, or 22 nucleotides (N) in length, which is followed by a loop sequence of defined sequence (X), comprising, for example, about 3 to about 10 nucleotides.

FIG. 7B: The synthetic construct is then extended by DNA polymerase to generate a hairpin structure having self-complementary sequence that will result in a siNA transcript having specificity for a target sequence and having self-complementary sense and antisense regions.

FIG. 7C: The construct is heated (for example to about 95° C.) to linearize the sequence, thus allowing extension of a complementary second DNA strand using a primer to the 3'-restriction sequence of the first strand. The double-stranded DNA is then inserted into an appropriate vector for expression in cells. The construct can be designed such that a 3'-terminal nucleotide overhang results from the transcription, for example, by engineering restriction sites and/or utilizing a poly-U termination region as described in Paul et al., 2002, *Nature Biotechnology*, 29, 505-508.

Figure 8:
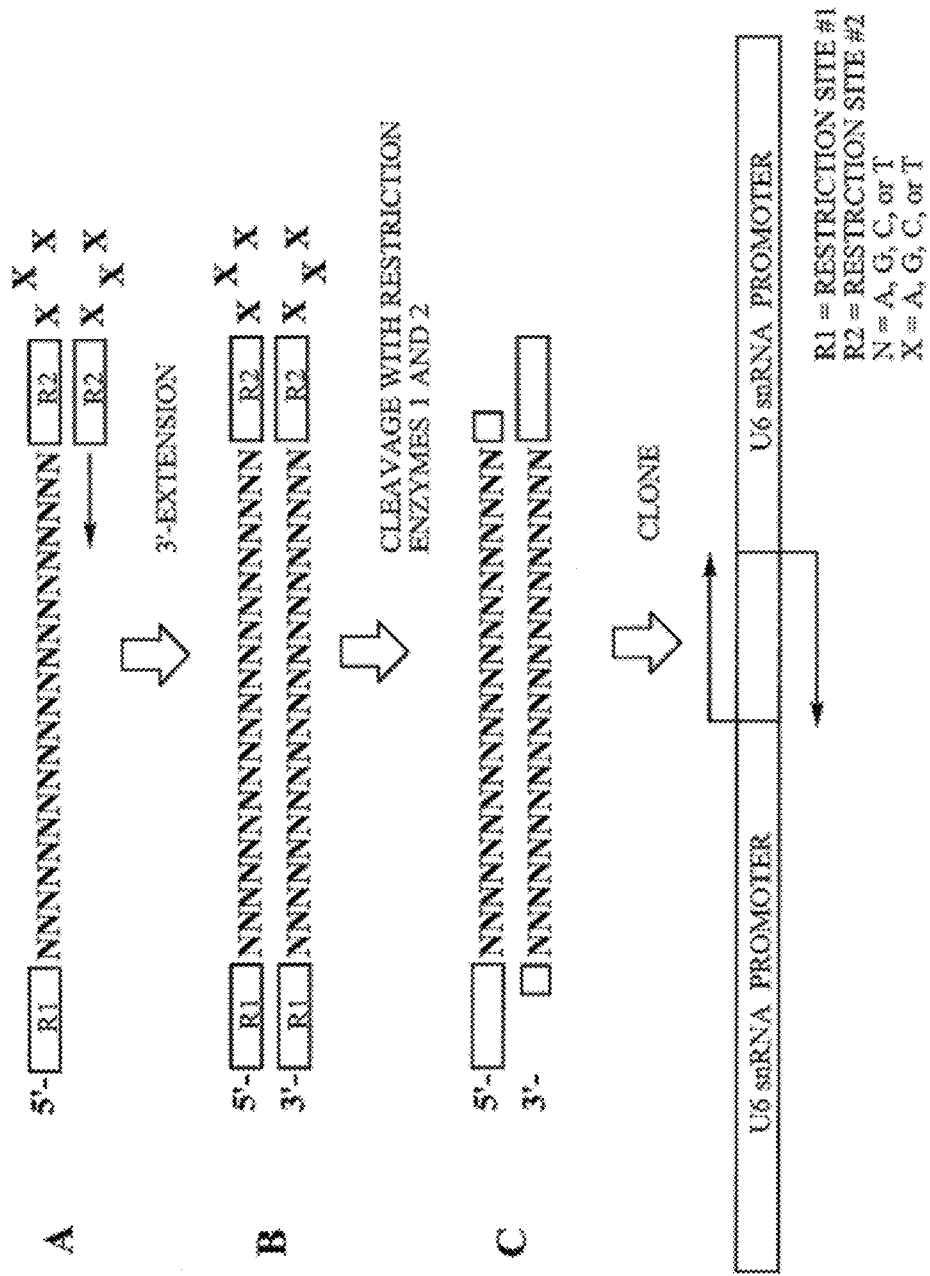

FIG. 8A-C is a diagrammatic representation of a scheme utilized in generating an expression cassette to generate double-stranded siNA constructs.

FIG. 8A: A DNA oligomer is synthesized with a 5'-restriction (R1) site sequence followed by a region having sequence identical (sense region of siNA) to a predetermined target sequence, wherein the sense region comprises, for example, about 19, 20, 21, or 22 nucleotides (N) in length, and which is followed by a 3'-restriction site (R2) which is adjacent to a loop sequence of defined sequence (X).

FIG. 8B: The synthetic construct is then extended by DNA polymerase to generate a hairpin structure having self-complementary sequence.

FIG. 8C: The construct is processed by restriction enzymes specific to R1 and R2 to generate a double-stranded DNA which is then inserted into an appropriate vector for expression in cells. The transcription cassette is designed such that a U6 promoter region flanks each side of the dsDNA which generates the separate sense and antisense strands of the siNA. Poly T termination sequences can be added to the constructs to generate U overhangs in the resulting transcript.

FIG. 9A-E is a diagrammatic representation of a method used to determine target sites for siNA mediated RNAi within a particular target nucleic acid sequence, such as messenger RNA.

FIG. 9A: A pool of siNA oligonucleotides are synthesized wherein the antisense region of the siNA constructs has complementarity to target sites across the target nucleic acid sequence, and wherein the sense region comprises sequence complementary to the antisense region of the siNA.

FIGS. 9B&C: (FIG. 9B) The sequences are pooled and are inserted into vectors such that (FIG. 9C) transfection of a vector into cells results in the expression of the siNA.

FIG. 9D: Cells are sorted based on phenotypic change that is associated with modulation of the target nucleic acid sequence.

FIG. 9E: The siNA is isolated from the sorted cells and is sequenced to identify efficacious target sites within the target nucleic acid sequence.

Figure 10:
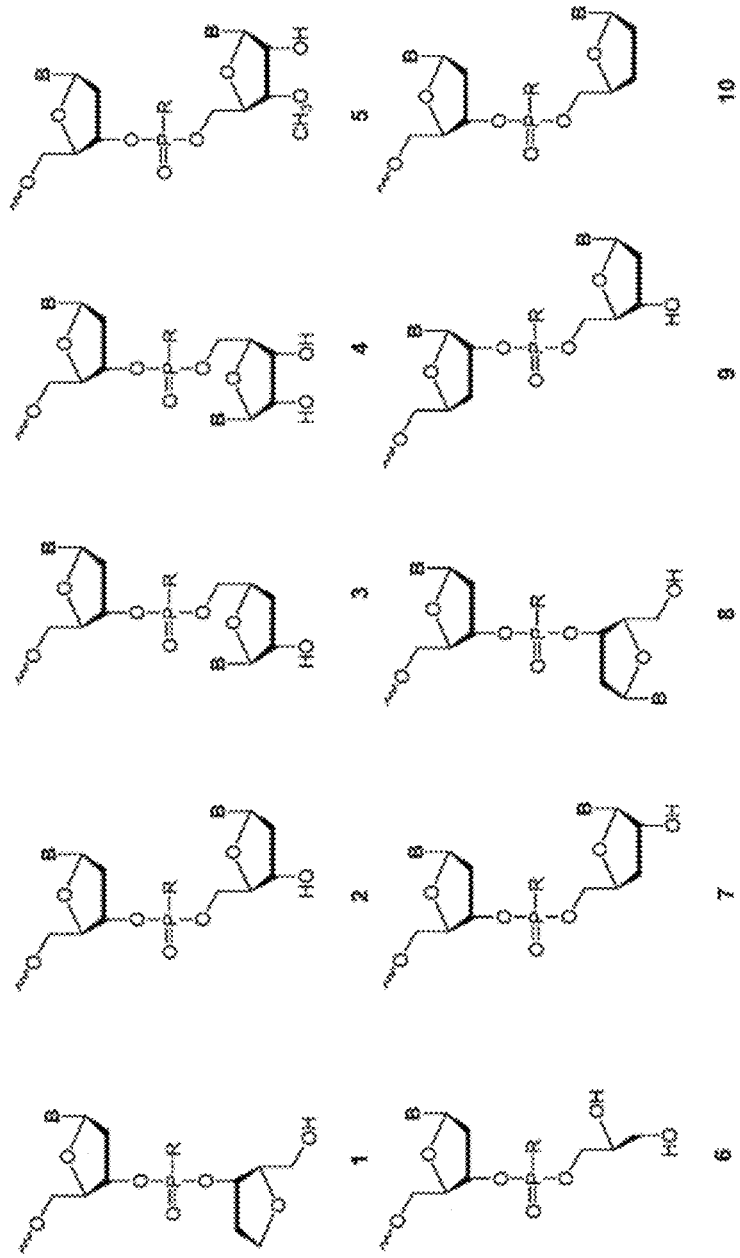

FIG. 10 shows non-limiting examples of different stabilization chemistries (1-10) that can be used, for example, to stabilize the 3'-end of siNA sequences of the invention, including (1) [3-3']-inverted deoxyribose; (2) deoxyribonucleotide; (3) [5'-3']-3'-deoxyribonucleotide; (4) [5'-3']-ribonucleotide; (5) [5'-3']-3'-O-methyl ribonucleotide; (6) 3'-glyceryl; (7) [3'-5']-3'-deoxyribonucleotide; (8) [3'-3']-deoxyribonucleotide; (9) [5'-2']-deoxyribonucleotide; and (10) [5-3']-dideoxyribonucleotide. In addition to modified and unmodified backbone chemistries indicated in the figure, these chemistries can be combined with different backbone modifications as described herein, for example, backbone modifications having Formula I. In addition, the 2'-deoxy nucleotide shown 5' to the terminal modifications shown can be another modified or unmodified nucleotide or non-nucleotide described herein, for example modifications having any of Formulae I-VII or any combination thereof.

FIG. 11 shows a non-limiting example of a strategy used to identify chemically modified siNA constructs of the invention that are nuclease resistance while preserving the ability to mediate RNAi activity. Chemical modifications are introduced into the siNA construct based on educated design parameters (e.g. introducing 2'-modifications, base modifications, backbone modifications, terminal cap modifications etc). The modified construct in tested in an appropriate system (e.g. human serum for nuclease resistance, shown, or an animal model for PK/delivery parameters). In parallel, the siNA construct is tested for RNAi activity, for example in a cell culture system such as a luciferase reporter assay). Lead siNA constructs are then identified which possess a particular characteristic while maintaining RNAi activity, and can be further modified and assayed once again. This same approach can be used to identify siNA-conjugate molecules with improved pharmacokinetic profiles, delivery, and RNAi activity.

FIG. 12 shows non-limiting examples of phosphorylated siNA molecules of the invention, including linear and duplex constructs and asymmetric derivatives thereof.

FIG. 13 shows non-limiting examples of chemically modified terminal phosphate groups of the invention.

FIG. 14A shows a non-limiting example of methodology used to design self complementary DFO constructs utilizing palindrome and/or repeat nucleic acid sequences that are identified in a target nucleic acid sequence. (i) A palindrome or repeat sequence is identified in a nucleic acid target sequence. (ii) A sequence is designed that is complementary to the target nucleic acid sequence and the palindrome sequence. (iii) An inverse repeat sequence of the non-palindrome/repeat portion of the complementary sequence is appended to the 3'-end of the complementary sequence to generate a self complementary DFO molecule comprising sequence complementary to the nucleic acid target. (iv) The DFO molecule can self-assemble to form a double stranded oligonucleotide. FIG. 14B shows a non-limiting representative example of a duplex forming oligonucleotide sequence. FIG. 14C shows a non-limiting example of the self assembly schematic of a representative duplex forming oligonucleotide sequence. FIG. 14D shows a non-limiting example of the self assembly schematic of a representative duplex forming oligonucleotide sequence followed by interaction with a target nucleic acid sequence resulting in modulation of gene expression.

FIG. 15 shows a non-limiting example of the design of self complementary DFO constructs utilizing palindrome and/or repeat nucleic acid sequences that are incorporated into the DFO constructs that have sequence complementary to any target nucleic acid sequence of interest. Incorporation of these palindrome/repeat sequences allow the design of DFO constructs that form duplexes in which each strand is capable of mediating modulation of target gene expression, for example by RNAi. First, the target sequence is identified. A complementary sequence is then generated in which nucleotide or non-nucleotide modifications (shown as X or Y) are introduced into the complementary sequence that generate an artificial palindrome (shown as XYXYXY in the Figure). An inverse repeat of the non-palindrome/repeat complementary sequence is appended to the 3'-end of the complementary sequence to generate a self complementary DFO comprising sequence complementary to the nucleic acid target. The DFO can self-assemble to form a double stranded oligonucleotide.

FIG. 16 shows non-limiting examples of multifunctional siNA molecules of the invention comprising two separate polynucleotide sequences that are each capable of mediating RNAi directed cleavage of differing target nucleic acid sequences. FIG. 16A shows a non-limiting example of a multifunctional siNA molecule having a first region that is complementary to a first target nucleic acid sequence (complementary region 1) and a second region that is complementary to a second target nucleic acid sequence (complementary region 2), wherein the first and second complementary regions are situated at the 3'-ends of each polynucleotide sequence in the multifunctional siNA. The dashed portions of each polynucleotide sequence of the multifunctional siNA construct have complementarity with regard to corresponding portions of the siNA duplex, but do not have complementarity to the target nucleic acid sequences. FIG. 16B shows a non-limiting example of a multifunctional siNA molecule having a first region that is complementary to a first target nucleic acid sequence (complementary region 1) and a second region that is complementary to a second target nucleic acid sequence (complementary region 2), wherein the first and second complementary regions are situated at the 5'-ends of each polynucleotide sequence in the multifunctional siNA. The dashed portions of each polynucleotide sequence of the multifunctional siNA construct have complementarity with regard to corresponding portions of the siNA duplex, but do not have complementarity to the target nucleic acid sequences.

FIG. 17 shows non-limiting examples of multifunctional siNA molecules of the invention comprising a single polynucleotide sequence comprising distinct regions that are each capable of mediating RNAi directed cleavage of differing target nucleic acid sequences.

FIG. 17A shows a non-limiting example of a multifunctional siNA molecule having a first region that is complementary to a first target nucleic acid sequence (complementary region 1) and a second region that is complementary to a second target nucleic acid sequence (complementary region 2), wherein the second complementary region is situated at the 3'-end of the polynucleotide sequence in the multifunctional siNA. The dashed portions of each polynucleotide sequence of the multifunctional siNA construct have complementarity with regard to corresponding portions of the siNA duplex, but do not have complementarity to the target nucleic acid sequences. FIG. 17B shows a non-limiting example of a multifunctional siNA molecule having a first region that is complementary to a first target nucleic acid sequence (complementary region 1) and a second region that is complementary to a second target nucleic acid sequence (complementary region 2), wherein the first complementary region is situated at the 5'-end of the polynucleotide sequence in the multifunctional siNA. The dashed portions of each polynucleotide sequence of the multifunctional siNA construct have complementarity with regard to corresponding portions of the siNA duplex, but do not have complementarity to the target nucleic acid sequences. In one embodiment, these multifunctional siNA constructs are processed in vivo or in vitro to generate multifunctional siNA constructs as shown in FIG. 16.

FIG. 18 shows non-limiting examples of multifunctional siNA molecules of the invention comprising two separate polynucleotide sequences that are each capable of mediating RNAi directed cleavage of differing target nucleic acid sequences and wherein the multifunctional siNA construct further comprises a self complementary, palindrome, or repeat region, thus enabling shorter bifunctional siNA constructs that can mediate RNA interference against differing target nucleic acid sequences. FIG. 18A shows a non-limiting example of a multifunctional siNA molecule having a first region that is complementary to a first target nucleic acid sequence (complementary region 1) and a second region that is complementary to a second target nucleic acid sequence (complementary region 2), wherein the first and second complementary regions are situated at the 3'-ends of each polynucleotide sequence in the multifunctional siNA, and wherein the first and second complementary regions further comprise a self complementary, palindrome, or repeat region. The dashed portions of each polynucleotide sequence of the multifunctional siNA construct have complementarity with regard to corresponding portions of the siNA duplex, but do not have complementarity to the target nucleic acid sequences. FIG. 18B shows a non-limiting example of a multifunctional siNA molecule having a first region that is complementary to a first target nucleic acid sequence (complementary region 1) and a second region that is complementary to a second target nucleic acid sequence (complementary region 2), wherein the first and second complementary regions are situated at the 5'-ends of each polynucleotide sequence in the multifunctional siNA, and wherein the first and second complementary regions further comprise a self complementary, palindrome, or repeat region. The dashed portions of each polynucleotide sequence of the multifunctional siNA construct have complementarity with regard to corresponding portions of the siNA duplex, but do not have complementarity to the target nucleic acid sequences.

FIG. 19 shows non-limiting examples of multifunctional siNA molecules of the invention comprising a single polynucleotide sequence comprising distinct regions that are each capable of mediating RNAi directed cleavage of differing target nucleic acid sequences and wherein the multifunctional siNA construct further comprises a self complementary, palindrome, or repeat region, thus enabling shorter bifunctional siNA constructs that can mediate RNA interference against differing target nucleic acid sequences. FIG. 19A shows a non-limiting example of a multifunctional siNA molecule having a first region that is complementary to a first target nucleic acid sequence (complementary region 1) and a second region that is complementary to a second target nucleic acid sequence (complementary region 2), wherein the second complementary region is situated at the 3'-end of the polynucleotide sequence in the multifunctional siNA, and wherein the first and second complementary regions further comprise a self complementary, palindrome, or repeat region. The dashed portions of each polynucleotide sequence of the multifunctional siNA construct have complementarity with regard to corresponding portions of the siNA duplex, but do not have complementarity to the target nucleic acid sequences. FIG. 19B shows a non-limiting example of a multifunctional siNA molecule having a first region that is complementary to a first target nucleic acid sequence (complementary region 1) and a second region that is complementary to a second target nucleic acid sequence (complementary region 2), wherein the first complementary region is situated at the 5'-end of the polynucleotide sequence in the multifunctional siNA, and wherein the first and second complementary regions further comprise a self complementary, palindrome, or repeat region. The dashed portions of each polynucleotide sequence of the multifunctional siNA construct have complementarity with regard to corresponding portions of the siNA duplex, but do not have complementarity to the target nucleic acid sequences. In one embodiment, these multifunctional siNA constructs are processed in vivo or in vitro to generate multifunctional siNA constructs as shown in FIG. 18.

FIG. 20 shows a non-limiting example of how multifunctional siNA molecules of the invention can target two separate target nucleic acid molecules, such as separate RNA molecules encoding differing proteins, for example, a cytokine and its corresponding receptor, differing viral strains, a virus and a cellular protein involved in viral infection or replication, or differing proteins involved in a common or divergent biologic pathway that is implicated in the maintenance of progression of disease. Each strand of the multifunctional siNA construct comprises a region having complementarity to separate target nucleic acid molecules. The multifunctional siNA molecule is designed such that each strand of the siNA can be utilized by the RISC to initiate RNA interference mediated cleavage of its corresponding target. These design parameters can include destabilization of each end of the siNA construct (see for example Schwarz et al., 2003, Cell, 115, 199-208). Such destabilization can be accomplished for example by using guanosine-cytidine base pairs, alternate base pairs (e.g., wobbles), or destabilizing chemically modified nucleotides at terminal nucleotide positions as is known in the art.

FIG. 21 shows a non-limiting example of how multifunctional siNA molecules of the invention can target two separate target nucleic acid sequences within the same target nucleic acid molecule, such as alternate coding regions of a RNA, coding and non-coding regions of a RNA, or alternate splice variant regions of a RNA. Each strand of the multifunctional siNA construct comprises a region having complementarity to the separate regions of the target nucleic acid molecule. The multifunctional siNA molecule is designed such that each strand of the siNA can be utilized by the RISC to initiate RNA interference mediated cleavage of its corresponding target region. These design parameters can include destabilization of each end of the siNA construct (see for example Schwarz et al., 2003, Cell, 115, 199-208). Such destabilization can be accomplished for example by using guanosine-cytidine base pairs, alternate base pairs (e.g., wobbles), or destabilizing chemically modified nucleotides at terminal nucleotide positions as is known in the art.

FIG. 22(A-H) shows non-limiting examples of tethered multifunctional siNA constructs of the invention. In the examples shown, a linker (e.g., nucleotide or non-nucleotide linker) connects two siNA regions (e.g., two sense, two antisense, or alternately a sense and an antisense region together. Separate sense (or sense and antisense) sequences corresponding to a first target sequence and second target sequence are hybridized to their corresponding sense and/or antisense sequences in the multifunctional siNA. In addition, various conjugates, ligands, aptamers, polymers or reporter molecules can be attached to the linker region for selective or improved delivery and/or pharmacokinetic properties.

FIG. 23 shows a non-limiting example of various dendrimer based multifunctional siNA designs.

FIG. 24 shows a non-limiting example of various supramolecular multifunctional siNA designs.

FIG. 25 shows a non-limiting example of a dicer enabled multifunctional siNA design using a 30 nucleotide precursor siNA construct. A 30 base pair duplex is cleaved by Dicer into 22 and 8 base pair products from either end (8 b.p. fragments not shown). For ease of presentation the overhangs generated by dicer are not shown—but can be compensated for. Three targeting sequences are shown. The required sequence identity overlapped is indicated by grey boxes. The N's of the parent 30 b.p. siNA are suggested sites of 2'-OH positions to enable Dicer cleavage if this is tested in stabilized chemistries. Note that processing of a 30mer duplex by Dicer RNase III does not give a precise 22+8 cleavage, but rather produces a series of closely related products (with 22+8 being the primary site). Therefore, processing by Dicer will yield a series of active siNAs.

FIG. 26 shows a non-limiting example of a dicer enabled multifunctional siNA design using a 40 nucleotide precursor siNA construct. A 40 base pair duplex is cleaved by Dicer into 20 base pair products from either end. For ease of presentation the overhangs generated by dicer are not shown—but can be compensated for. Four targeting sequences are shown. The target sequences having homology are enclosed by boxes. This design format can be extended to larger RNAs. If chemically stabilized siNAs are bound by Dicer, then strategically located ribonucleotide linkages can enable designer cleavage products that permit our more extensive repertoire of multifunctional designs. For example cleavage products not limited to the Dicer standard of approximately 22-nucleotides can allow multifunctional siNA constructs with a target sequence identity overlap ranging from, for example, about 3 to about 15 nucleotides.

FIG. 27 shows a non-limiting example of additional multifunctional siNA construct designs of the invention. In one example, a conjugate, ligand, aptamer, label, or other moiety is attached to a region of the multifunctional siNA to enable improved delivery or pharmacokinetic profiling.

FIG. 28 shows a non-limiting example of additional multifunctional siNA construct designs of the invention. In one example, a conjugate, ligand, aptamer, label, or other moiety is attached to a region of the multifunctional siNA to enable improved delivery or pharmacokinetic profiling.

FIG. 29 shows a non-limiting example of a cholesterol linked phosphoramidite that can be used to synthesize cholesterol conjugated siNA molecules of the invention. An example is shown with the cholesterol moiety linked to the 5'-end of the sense strand of a siNA molecule.

DETAILED DESCRIPTION OF THE INVENTION

Mechanism of Action of Nucleic Acid Molecules of the Invention

The discussion that follows discusses the proposed mechanism of RNA interference mediated by short interfering RNA as is presently known, and is not meant to be limiting and is not an admission of prior art. Applicant demonstrates herein that chemically-modified short interfering nucleic acids possess similar or improved capacity to mediate RNAi as do siRNA molecules and are expected to possess improved stability and activity in vivo; therefore, this discussion is not meant to be limiting only to siRNA and can be applied to siNA as a whole. By "improved capacity to mediate RNAi" or "improved RNAi activity" is meant to include RNAi activity measured in vitro and/or in vivo where the RNAi activity is a reflection of both the ability of the siNA to mediate RNAi and the stability of the siNAs of the invention. In this invention, the product of these activities can be increased in vitro and/or in vivo compared to an all RNA siRNA or a siNA containing a plurality of ribonucleotides. In some cases, the activity or stability of the siNA molecule can be decreased (i.e., less than ten-fold), but the overall activity of the siNA molecule is enhanced in vitro and/or in vivo.

RNA interference refers to the process of sequence specific post-transcriptional gene silencing in animals mediated by short interfering RNAs (siRNAs) (Fire et al., 1998, Nature, 391, 806). The corresponding process in plants is commonly referred to as post-transcriptional gene silencing or RNA silencing and is also referred to as quelling in fungi. The process of post-transcriptional gene silencing is thought to be an evolutionarily-conserved cellular defense mechanism used to prevent the expression of foreign genes which is commonly shared by diverse flora and phyla (Fire et al., 1999, Trends Genet., 15, 358). Such protection from foreign gene expression may have evolved in response to the production of double-stranded RNAs (dsRNAs) derived from viral infection or the random integration of transposon elements into a host genome via a cellular response that specifically destroys homologous single-stranded RNA or viral genomic RNA. The presence of dsRNA in cells triggers the RNAi response though a mechanism that has yet to be fully characterized. This mechanism appears to be different from the interferon response that results from dsRNA-mediated activation of protein kinase PKR and 2',5'-oligoadenylate synthetase resulting in non-specific cleavage of mRNA by ribonuclease L.

The presence of long dsRNAs in cells stimulates the activity of a ribonuclease III enzyme referred to as Dicer. Dicer is involved in the processing of the dsRNA into short pieces of dsRNA known as short interfering RNAs (siRNAs) (Berstein et al., 2001, *Nature*, 409, 363). Short interfering RNAs derived from Dicer activity are typically about 21 to about 23 nucleotides in length and comprise about 19 base pair duplexes. Dicer has also been implicated in the excision of 21- and 22-nucleotide small temporal RNAs (stRNAs) from precursor RNA of conserved structure that are implicated in translational control (Hutvagner et al., 2001, *Science*, 293, 834). The RNAi response also features an endonuclease complex containing a siRNA, commonly referred to as an RNA-induced silencing complex (RISC), which mediates cleavage of single-stranded RNA having sequence homologous to the siRNA. Cleavage of the target RNA takes place in the middle of the region complementary to the guide sequence of the siRNA duplex (Elbashir et al., 2001, *Genes Dev.*, 15, 188). In addition, RNA interference can also involve small RNA (e.g., micro-RNA or miRNA) mediated gene silencing, presumably though cellular mechanisms that regulate chromatin structure and thereby prevent transcription of target gene sequences (see for example Allshire, 2002, *Science*, 297, 1818-1819; Volpe et al., 2002, *Science*, 297, 1833-1837; Jenuwein, 2002, *Science*, 297, 2215-2218; and Hall et al., 2002, *Science*, 297, 2232-2237). As such, siNA molecules of the invention can be used to mediate gene silencing via interaction with RNA transcripts or alternately by interaction with particular gene sequences, wherein such interaction results in gene silencing either at the transcriptional level or post-transcriptional level.

RNAi has been studied in a variety of systems. Fire et al., 1998, *Nature*, 391, 806, were the first to observe RNAi in *C. elegans*. Wianny and Goetz, 1999, *Nature Cell Biol.*, 2, 70, describe RNAi mediated by dsRNA in mouse embryos. Hammond et al., 2000, *Nature*, 404, 293, describe RNAi in *Drosophila* cells transfected with dsRNA. Elbashir et al., 2001, *Nature*, 411, 494, describe RNAi induced by introduction of duplexes of synthetic 21-nucleotide RNAs in cultured mammalian cells including human embryonic kidney and HeLa cells. Recent work in *Drosophila* embryonic lysates has revealed certain requirements for siRNA length, structure, chemical composition, and sequence that are essential to mediate efficient RNAi activity. These studies have shown that 21 nucleotide siRNA duplexes are most active when containing two 2-nucleotide 3'-terminal nucleotide overhangs. Furthermore, substitution of one or both siRNA strands with 2'-deoxy or 2'-O-methyl nucleotides abolishes RNAi activity, whereas substitution of 3'-terminal siRNA nucleotides with deoxy nucleotides was shown to be tolerated. Mismatch sequences in the center of the siRNA duplex were also shown to abolish RNAi activity. In addition, these studies also indicate that the position of the cleavage site in the target RNA is defined by the 5'-end of the siRNA guide sequence rather than the 3'-end (Elbashir et al., 2001, *EMBO J.*, 20, 6877). Other studies have indicated that a 5'-phosphate on the target-complementary strand of a siRNA duplex is required for siRNA activity and that ATP is utilized to maintain the 5'-phosphate moiety on the siRNA (Nykanen et al., 2001, *Cell*, 107, 309); however, siRNA molecules lacking a 5'-phosphate are active when introduced exogenously, suggesting that 5'-phosphorylation of siRNA constructs may occur in vivo.

Duplex Forming Oligonucleotides (DFO) of the Invention

In one embodiment, the invention features siNA molecules comprising duplex forming oligonucleotides (DFO) that can self-assemble into double stranded oligonucleotides. The duplex forming oligonucleotides of the invention can be chemically synthesized or expressed from transcription units and/or vectors. The DFO molecules of the instant invention provide useful reagents and methods for a variety of therapeutic, diagnostic, agricultural, veterinary, target validation, genomic discovery, genetic engineering and pharmacogenomic applications.

Applicant demonstrates herein that certain oligonucleotides, referred to herein for convenience but not limitation as duplex forming oligonucleotides or DFO molecules, are potent mediators of sequence specific regulation of gene expression. The oligonucleotides of the invention are distinct from other nucleic acid sequences known in the art (e.g., siRNA, miRNA, stRNA, shRNA, antisense oligonucleotides etc.) in that they represent a class of linear polynucleotide sequences that are designed to self-assemble into double stranded oligonucleotides, where each strand in the double stranded oligonucleotides comprises a nucleotide sequence that is complementary to a RSV target nucleic acid molecule. Nucleic acid molecules of the invention can thus self assemble into functional duplexes in which each strand of the duplex comprises the same polynucleotide sequence and each strand comprises a nucleotide sequence that is complementary to a RSV target nucleic acid molecule.

Generally, double stranded oligonucleotides are formed by the assembly of two distinct oligonucleotide sequences where the oligonucleotide sequence of one strand is complementary to the oligonucleotide sequence of the second strand; such double stranded oligonucleotides are assembled from two separate oligonucleotides, or from a single molecule that folds on itself to form a double stranded structure, often referred to in the field as hairpin stem-loop structure (e.g., shRNA or short hairpin RNA). These double stranded oligonucleotides known in the art all have a common feature in that each strand of the duplex has a distinct nucleotide sequence.

Distinct from the double stranded nucleic acid molecules known in the art, the applicants have developed a novel, potentially cost effective and simplified method of forming a double stranded nucleic acid molecule starting from a single stranded or linear oligonucleotide. The two strands of the double stranded oligonucleotide formed according to the instant invention have the same nucleotide sequence and are not covalently linked to each other. Such double-stranded oligonucleotides molecules can be readily linked post-synthetically by methods and reagents known in the art and are within the scope of the invention. In one embodiment, the single stranded oligonucleotide of the invention (the duplex forming oligonucleotide) that forms a double stranded oligonucleotide comprises a first region and a second region, where the second region includes a nucleotide sequence that is an inverted repeat of the nucleotide sequence in the first region, or a portion thereof, such that the single stranded oligonucleotide self assembles to form a duplex oligonucleotide in which the nucleotide sequence of one strand of the duplex is the same as the nucleotide sequence of the second strand. Non-limiting examples of such duplex forming oligonucleotides are illustrated in FIGS. 14 and 15. These duplex forming oligonucleotides (DFOs) can optionally include certain palindrome or repeat sequences where such palindrome or repeat sequences are present in between the first region and the second region of the DFO.

In one embodiment, the invention features a duplex forming oligonucleotide (DFO) molecule, wherein the DFO comprises a duplex forming self complementary nucleic acid sequence that has nucleotide sequence complementary to a RSV target nucleic acid sequence. The DFO molecule can comprise a single self complementary sequence or a duplex resulting from assembly of such self complementary sequences.

In one embodiment, a duplex forming oligonucleotide (DFO) of the invention comprises a first region and a second region, wherein the second region comprises a nucleotide sequence comprising an inverted repeat of nucleotide sequence of the first region such that the DFO molecule can assemble into a double stranded oligonucleotide. Such double stranded oligonucleotides can act as a short interfering nucleic acid (siNA) to modulate gene expression. Each strand of the double stranded oligonucleotide duplex formed by DFO molecules of the invention can comprise a nucleotide sequence region that is complementary to the same nucleotide sequence in a RSV target nucleic acid molecule (e.g., RSV target RNA).

In one embodiment, the invention features a single stranded DFO that can assemble into a double stranded oligonucleotide. The applicant has surprisingly found that a single stranded oligonucleotide with nucleotide regions of self complementarity can readily assemble into duplex oligonucleotide constructs. Such DFOs can assemble into duplexes that can inhibit gene expression in a sequence specific manner. The DFO molecules of the invention comprise a first region with nucleotide sequence that is complementary to the nucleotide sequence of a second region and where the sequence of the first region is complementary to a RSV target nucleic acid (e.g., RNA). The DFO can form a double stranded oligonucleotide wherein a portion of each strand of the double stranded oligonucleotide comprises a sequence complementary to a RSV target nucleic acid sequence.

In one embodiment, the invention features a double stranded oligonucleotide, wherein the two strands of the double stranded oligonucleotide are not covalently linked to each other, and wherein each strand of the double stranded oligonucleotide comprises a nucleotide sequence that is complementary to the same nucleotide sequence in a RSV target nucleic acid molecule or a portion thereof (e.g., RSV RNA target). In another embodiment, the two strands of the double stranded oligonucleotide share an identical nucleotide sequence of at least about 15, preferably at least about 16, 17, 18, 19, 20, or 21 nucleotides.

In one embodiment, a DFO molecule of the invention comprises a structure having Formula DFO-I:

```
5'-p-X Z X'-3'
``` wherein Z comprises a palindromic or repeat nucleic acid sequence optionally with one or more modified nucleotides (e.g., nucleotide with a modified base, such as 2-amino purine, 2-amino-1,6-dihydro purine or a universal base), for example of length about 2 to about 24 nucleotides in even numbers (e.g., about 2, 4, 6, 8, 10, 12, 14, 16, 18, 20, or 22 or 24 nucleotides), X represents a nucleic acid sequence, for example of length of about 1 to about 21 nucleotides (e.g., about 1, 2, 3, 4, 5, 6, 7, 8, 9, 10, 11, 12, 13, 14, 15, 16, 17, 18, 19, 20, or 21 nucleotides), X' comprises a nucleic acid sequence, for example of length about 1 and about 21 nucleotides (e.g., about 1, 2, 3, 4, 5, 6, 7, 8, 9, 10, 11, 12, 13, 14, 15, 16, 17, 18, 19, or 21 nucleotides) having nucleotide sequence complementarity to sequence X or a portion thereof, p comprises a terminal phosphate group that can be present or absent, and wherein sequence X and Z, either independently or together, comprise nucleotide sequence that is complementary to a RSV target nucleic acid sequence or a portion thereof and is of length sufficient to interact (e.g., base pair) with the RSV target nucleic acid sequence or a portion thereof (e.g., RSV RNA target). For example, X independently can comprise a sequence from about 12 to about 21 or more (e.g., about 12, 13, 14, 15, 16, 17, 18, 19, 20, 21, or more) nucleotides in length that is complementary to nucleotide sequence in a RSV target RNA or a portion thereof. In another non-limiting example, the length of the nucleotide sequence of X and Z together, when X is present, that is complementary to the RSV target RNA or a portion thereof (e.g., RSV RNA target) is from about 12 to about 21 or more nucleotides (e.g., about 12, 13, 14, 15, 16, 17, 18, 19, 20, 21, or more). In yet another non-limiting example, when X is absent, the length of the nucleotide sequence of Z that is complementary to the RSV target RNA or a portion thereof is from about 12 to about 24 or more nucleotides (e.g., about 12, 14, 16, 18, 20, 22, 24, or more). In one embodiment X, Z and X' are independently oligonucleotides, where X and/or Z comprises a nucleotide sequence of length sufficient to interact (e.g., base pair) with a nucleotide sequence in the RSV target RNA or a portion thereof (e.g., RSV RNA target). In one embodiment, the lengths of oligonucleotides X and X' are identical. In another embodiment, the lengths of oligonucleotides X and X' are not identical. In another embodiment, the lengths of oligonucleotides X and Z, or Z and X', or X, Z and X' are either identical or different.

When a sequence is described in this specification as being of "sufficient" length to interact (i.e., base pair) with another sequence, it is meant that the length is such that the number of bonds (e.g., hydrogen bonds) formed between the two sequences is enough to enable the two sequence to form a duplex under the conditions of interest. Such conditions can be in vitro (e.g., for diagnostic or assay purposes) or in vivo (e.g., for therapeutic purposes). It is a simple and routine matter to determine such lengths.

In one embodiment, the invention features a double stranded oligonucleotide construct having Formula DFO-I (a):

```
5'-p-X Z X'-3'

3'-X' Z X-p-5'
``` wherein Z comprises a palindromic or repeat nucleic acid sequence or palindromic or repeat-like nucleic acid sequence with one or more modified nucleotides (e.g., nucleotides with a modified base, such as 2-amino purine, 2-amino-1,6-dihydro purine or a universal base), for example of length about 2 to about 24 nucleotides in even numbers (e.g., about 2, 4, 6, 8, 10, 12, 14, 16, 18, 20, 22 or 24 nucleotides), X represents a nucleic acid sequence, for example of length about 1 to about 21 nucleotides (e.g., about 1, 2, 3, 4, 5, 6, 7, 8, 9, 10, 11, 12, 13, 14, 15, 16, 17, 18, 19, 20, or 21 nucleotides), X' comprises a nucleic acid sequence, for example of length about 1 to about 21 nucleotides (e.g., about 1, 2, 3, 4, 5, 6, 7, 8, 9, 10, 11, 12, 13, 14, 15, 16, 17, 18, 19, 20 or 21 nucleotides) having nucleotide sequence complementarity to sequence X or a portion thereof, p comprises a terminal phosphate group that can be present or absent, and wherein each X and Z independently comprises a nucleotide sequence that is complementary to a RSV target nucleic acid sequence or a portion thereof (e.g., RSV RNA target) and is of length sufficient to interact with the RSV target nucleic acid sequence of a portion thereof (e.g., RSV RNA target). For example, sequence X independently can comprise a sequence from about 12 to about 21 or more nucleotides (e.g., about 12, 13, 14, 15, 16, 17, 18, 19, 20, 21, or more) in length that is complementary to a nucleotide sequence in a RSV target RNA or a portion thereof (e.g., RSV RNA target). In another non-limiting example, the length of the nucleotide sequence of X and Z together (when X is present) that is complementary to the RSV target RNA or a portion thereof is from about 12 to about 21 or more nucleotides (e.g., about 12, 13, 14, 15, 16, 17, 18, 19, 20, 21, or more). In yet another non-limiting example, when X is absent, the length of the nucleotide sequence of Z that is complementary to the RSV target RNA or a portion thereof is from about 12 to about 24 or more nucleotides (e.g., about 12, 14, 16, 18, 20, 22, 24 or more). In one embodiment X, Z and X' are independently oligonucleotides, where X and/or Z comprises a nucleotide sequence of length sufficient to interact (e.g., base pair) with nucleotide sequence in the RSV target RNA or a portion thereof (e.g., RSV RNA target). In one embodiment, the lengths of oligonucleotides X and X' are identical. In another embodiment, the lengths of oligonucleotides X and X' are not identical. In another embodiment, the lengths of oligonucleotides X and Z or Z and X' or X, Z and X' are either identical or different. In one embodiment, the double stranded oligonucleotide construct of Formula I(a) includes one or more, specifically 1, 2, 3 or 4, mismatches, to the extent such mismatches do not significantly diminish the ability of the double stranded oligonucleotide to inhibit RSV target gene expression.

In one embodiment, a DFO molecule of the invention comprises structure having Formula DFO-II:

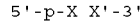

wherein each X and X' are independently oligonucleotides of length about 12 nucleotides to about 21 nucleotides, wherein X comprises, for example, a nucleic acid sequence of length about 12 to about 21 nucleotides (e.g., about 12, 13, 14, 15, 16, 17, 18, 19, 20 or 21 nucleotides), X' comprises a nucleic acid sequence, for example of length about 12 to about 21 nucleotides (e.g., about 12, 13, 14, 15, 16, 17, 18, 19, 20, or 21 nucleotides) having nucleotide sequence complementarity to sequence X or a portion thereof, p comprises a terminal phosphate group that can be present or absent, and wherein X comprises a nucleotide sequence that is complementary to a RSV target nucleic acid sequence (e.g., RSV target RNA) or a portion thereof and is of length sufficient to interact (e.g., base pair) with the RSV target nucleic acid sequence of a portion thereof. In one embodiment, the length of oligonucleotides X and X' are identical. In another embodiment the length of oligonucleotides X and X' are not identical. In one embodiment, length of the oligonucleotides X and X' are sufficient to form a relatively stable double stranded oligonucleotide.

In one embodiment, the invention features a double stranded oligonucleotide construct having Formula DFO-II(a):

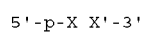

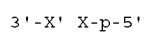

wherein each X and X' are independently oligonucleotides of length about 12 nucleotides to about 21 nucleotides, wherein X comprises a nucleic acid sequence, for example of length about 12 to about 21 nucleotides (e.g., about 12, 13, 14, 15, 16, 17, 18, 19, 20 or 21 nucleotides), X' comprises a nucleic acid sequence, for example of length about 12 to about 21 nucleotides (e.g., about 12, 13, 14, 15, 16, 17, 18, 19, 20 or 21 nucleotides) having nucleotide sequence complementarity to sequence X or a portion thereof, p comprises a terminal phosphate group that can be present or absent, and wherein X comprises nucleotide sequence that is complementary to a RSV target nucleic acid sequence or a portion thereof (e.g., RSV RNA target) and is of length sufficient to interact (e.g., base pair) with the RSV target nucleic acid sequence (e.g., RSV target RNA) or a portion thereof. In one embodiment, the lengths of oligonucleotides X and X' are identical. In another embodiment, the lengths of oligonucleotides X and X' are not identical. In one embodiment, the lengths of the oligonucleotides X and X' are sufficient to form a relatively stable double stranded oligonucleotide. In one embodiment, the double stranded oligonucleotide construct of Formula II(a) includes one or more, specifically 1, 2, 3 or 4, mismatches, to the extent such mismatches do not significantly diminish the ability of the double stranded oligonucleotide to inhibit RSV target gene expression.

In one embodiment, the invention features a DFO molecule having Formula DFO-I(b):

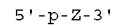

where Z comprises a palindromic or repeat nucleic acid sequence optionally including one or more non-standard or modified nucleotides (e.g., nucleotide with a modified base, such as 2-amino purine or a universal base) that can facilitate base-pairing with other nucleotides. Z can be, for example, of length sufficient to interact (e.g., base pair) with nucleotide sequence of a RSV target nucleic acid (e.g., RSV target RNA) molecule, preferably of length of at least 12 nucleotides, specifically about 12 to about 24 nucleotides (e.g., about 12, 14, 16, 18, 20, 22 or 24 nucleotides). p represents a terminal phosphate group that can be present or absent.

In one embodiment, a DFO molecule having any of Formula DFO-I, DFO-I(a), DFO-I(b), DFO-II(a) or DFO-II can comprise chemical modifications as described herein without limitation, such as, for example, nucleotides having any of Formulae I-VII, stabilization chemistries as described in Table IV, or any other combination of modified nucleotides and non-nucleotides as described in the various embodiments herein.

In one embodiment, the palindrome or repeat sequence or modified nucleotide (e.g., nucleotide with a modified base, such as 2-amino purine or a universal base) in Z of DFO constructs having Formula DFO-I, DFO-I(a) and DFO-I(b), comprises chemically modified nucleotides that are able to interact with a portion of the RSV target nucleic acid sequence (e.g., modified base analogs that can form Watson Crick base pairs or non-Watson Crick base pairs).

In one embodiment, a DFO molecule of the invention, for example a DFO having Formula DFO-I or DFO-II, comprises about 15 to about 40 nucleotides (e.g., about 15, 16, 17, 18, 19, 20, 21, 22, 23, 24, 25, 26, 27, 28, 29, 30, 31, 32, 33, 34, 35, 36, 37, 38, 39, or 40 nucleotides). In one embodiment, a DFO molecule of the invention comprises one or more chemical modifications. In a non-limiting example, the introduction of chemically modified nucleotides and/or non-nucleotides into nucleic acid molecules of the invention provides a powerful tool in overcoming potential limitations of in vivo stability and bioavailability inherent to unmodified RNA molecules that are delivered exogenously. For example, the use of chemically modified nucleic acid molecules can enable a lower dose of a particular nucleic acid molecule for a given therapeutic effect since chemically modified nucleic acid molecules tend to have a longer half-life in serum or in cells or tissues. Furthermore, certain chemical modifications can improve the bioavailability and/or potency of nucleic acid molecules by not only enhancing half-life but also facilitating the targeting of nucleic acid molecules to particular organs, cells or tissues and/or improving cellular uptake of the nucleic acid molecules. Therefore, even if the activity of a chemically modified nucleic acid molecule is reduced in vitro as compared to a native/unmodified nucleic acid molecule, for example when compared to an unmodified RNA molecule, the overall activity of the modified nucleic acid molecule can be greater than the native or unmodified nucleic acid molecule due to improved stability, potency, duration of effect, bioavailability and/or delivery of the molecule.

Multifunctional or Multi-targeted siNA Molecules of the Invention

In one embodiment, the invention features siNA molecules comprising multifunctional short interfering nucleic acid (multifunctional siNA) molecules that modulate the expression of one or more genes in a biologic system, such as a cell, tissue, or organism. The multifunctional short interfering nucleic acid (multifunctional siNA) molecules of the invention can target more than one region of the RSV or cellular/host target nucleic acid sequence or can target sequences of more than one distinct target nucleic acid molecules (e.g., RSV RNA or cellular/host RNA targets). The multifunctional siNA molecules of the invention can be chemically synthesized or expressed from transcription units and/or vectors. The multifunctional siNA molecules of the instant invention provide useful reagents and methods for a variety of human applications, therapeutic, diagnostic, agricultural, veterinary, target validation, genomic discovery, genetic engineering and pharmacogenomic applications.

Applicant demonstrates herein that certain oligonucleotides, referred to herein for convenience but not limitation as multifunctional short interfering nucleic acid or multifunctional siNA molecules, are potent mediators of sequence specific regulation of gene expression. The multifunctional siNA molecules of the invention are distinct from other nucleic acid sequences known in the art (e.g., siRNA, miRNA, stRNA, shRNA, antisense oligonucleotides, etc.) in that they represent a class of polynucleotide molecules that are designed such that each strand in the multifunctional siNA construct comprises a nucleotide sequence that is complementary to a distinct nucleic acid sequence in one or more target nucleic acid molecules. A single multifunctional siNA molecule (generally a double-stranded molecule) of the invention can thus target more than one (e.g., 2, 3, 4, 5, or more) differing target nucleic acid target molecules. Nucleic acid molecules of the invention can also target more than one (e.g., 2, 3, 4, 5, or more) region of the same target nucleic acid sequence. As such multifunctional siNA molecules of the invention are useful in down regulating or inhibiting the expression of one or more target nucleic acid molecules. For example, a multifunctional siNA molecule of the invention can target nucleic acid molecules encoding a virus or viral proteins (e.g. nucleopretein (N), large (L) and phosphoproteins (P), matrix (M), fusion (F), glycoprotein (G), NS1 and 2 non-structural proteins, including small hydrophobic (SH) and M2 protein targets) and corresponding cellular proteins required for viral infection and/or replication, or differing strains or subtypes of a particular virus (e.g., RSV subtype A and subtype B and different strains thereof). By reducing or inhibiting expression of more than one target nucleic acid molecule with one multifunctional siNA construct, multifunctional siNA molecules of the invention represent a class of potent therapeutic agents that can provide simultaneous inhibition of multiple targets within a disease or pathogen related pathway. Such simultaneous inhibition can provide synergistic therapeutic treatment strategies without the need for separate preclinical and clinical development efforts or complex regulatory approval process.

Use of multifunctional siNA molecules that target more then one region of a target nucleic acid molecule (e.g., messenger RNA or RSV RNA) is expected to provide potent inhibition of gene expression. For example, a single multifunctional siNA construct of the invention can target both conserved and variable regions of a target nucleic acid molecule (e.g., RSV RNA), thereby allowing down regulation or inhibition of different strain variants or a virus, or splice variants encoded by a single host gene, or allowing for targeting of both coding and non-coding regions of the host target nucleic acid molecule.

Generally, double stranded oligonucleotides are formed by the assembly of two distinct oligonucleotides where the oligonucleotide sequence of one strand is complementary to the oligonucleotide sequence of the second strand; such double stranded oligonucleotides are generally assembled from two separate oligonucleotides (e.g., siRNA). Alternately, a duplex can be formed from a single molecule that folds on itself (e.g., shRNA or short hairpin RNA). These double stranded oligonucleotides are known in the art to mediate RNA interference and all have a common feature wherein only one nucleotide sequence region (guide sequence or the antisense sequence) has complementarity to a target nucleic acid sequence, and the other strand (sense sequence) comprises nucleotide sequence that is homologous to the target nucleic acid sequence. Generally, the antisense sequence is retained in the active RISC and guides the RISC to the target nucleotide sequence by means of complementary base-pairing of the antisense sequence with the target sequence for mediating sequence-specific RNA interference. It is known in the art that in some cell culture systems, certain types of unmodified siRNAs can exhibit "off target" effects. It is hypothesized that this off-target effect involves the participation of the sense sequence instead of the antisense sequence of the siRNA in the RISC (see for example Schwarz et al., 2003, Cell, 115, 199-208). In this instance the sense sequence is believed to direct the RISC to a sequence (off-target sequence) that is distinct from the intended target sequence, resulting in the inhibition of the off-target sequence. In these double stranded nucleic acid molecules, each strand is complementary to a distinct target nucleic acid sequence. However, the off-targets that are affected by these dsRNAs are not entirely predictable and are non-specific.

Distinct from the double stranded nucleic acid molecules known in the art, the applicants have developed a novel, potentially cost effective and simplified method of down regulating or inhibiting the expression of more than one target nucleic acid sequence using a single multifunctional siNA construct. The multifunctional siNA molecules of the invention are designed to be double-stranded or partially double stranded, such that a portion of each strand or region of the multifunctional siNA is complementary to a target nucleic acid sequence of choice. As such, the multifunctional siNA molecules of the invention are not limited to targeting sequences that are complementary to each other, but rather to any two differing target nucleic acid sequences. Multifunctional siNA molecules of the invention are designed such that each strand or region of the multifunctional siNA molecule, that is complementary to a given target nucleic acid sequence, is of suitable length (e.g., from about 16 to about 28 nucleotides in length, preferably from about 18 to about 28 nucleotides in length) for mediating RNA interference against the target nucleic acid sequence. The complementarity between the target nucleic acid sequence and a strand or region of the multifunctional siNA must be sufficient (at least about 8 base pairs) for cleavage of the target nucleic acid sequence by RNA interference. Multifunctional siNA of the invention is expected to minimize off-target effects seen with certain siRNA sequences, such as those described in Schwarz et al., supra.

It has been reported that dsRNAs of length between 29 base pairs and 36 base pairs (Tuschl et al., International PCT Publication No. WO 02/44321) do not mediate RNAi. One reason these dsRNAs are inactive may be the lack of turnover or dissociation of the strand that interacts with the target RNA sequence, such that the RISC is not able to efficiently interact with multiple copies of the target RNA resulting in a significant decrease in the potency and efficiency of the RNAi process. Applicant has surprisingly found that the multifunctional siNAs of the invention can overcome this hurdle and are capable of enhancing the efficiency and potency of RNAi process. As such, in certain embodiments of the invention, multifunctional siNAs of length of about 29 to about 36 base pairs can be designed such that, a portion of each strand of the multifunctional siNA molecule comprises a nucleotide sequence region that is complementary to a target nucleic acid of length sufficient to mediate RNAi efficiently (e.g., about 15 to about 23 base pairs) and a nucleotide sequence region that is not complementary to the target nucleic acid. By having both complementary and non-complementary portions in each strand of the multifunctional siNA, the multifunctional siNA can mediate RNA interference against a target nucleic acid sequence without being prohibitive to turnover or dissociation (e.g., where the length of each strand is too long to mediate RNAi against the respective target nucleic acid sequence). Furthermore, design of multifunctional siNA molecules of the invention with internal overlapping regions allows the multifunctional siNA molecules to be of favorable (decreased) size for mediating RNA interference and of size that is well suited for use as a therapeutic agent (e.g., wherein each strand is independently from about 18 to about 28 nucleotides in length). Non-limiting examples are illustrated in FIGS. 16-28.

In one embodiment, a multifunctional siNA molecule of the invention comprises a first region and a second region, where the first region of the multifunctional siNA comprises a nucleotide sequence complementary to a nucleic acid sequence of a first target nucleic acid molecule, and the second region of the multifunctional siNA comprises nucleic acid sequence complementary to a nucleic acid sequence of a second target nucleic acid molecule. In one embodiment, a multifunctional siNA molecule of the invention comprises a first region and a second region, where the first region of the multifunctional siNA comprises nucleotide sequence complementary to a nucleic acid sequence of the first region of a target nucleic acid molecule, and the second region of the multifunctional siNA comprises nucleotide sequence complementary to a nucleic acid sequence of a second region of a the target nucleic acid molecule. In another embodiment, the first region and second region of the multifunctional siNA can comprise separate nucleic acid sequences that share some degree of complementarity (e.g., from about 1 to about 10 complementary nucleotides). In certain embodiments, multifunctional siNA constructs comprising separate nucleic acid sequences can be readily linked post-synthetically by methods and reagents known in the art and such linked constructs are within the scope of the invention. Alternately, the first region and second region of the multifunctional siNA can comprise a single nucleic acid sequence having some degree of self complementarity, such as in a hairpin or stem-loop structure. Non-limiting examples of such double stranded and hairpin multifunctional short interfering nucleic acids are illustrated in FIGS. 16 and 17 respectively. These multifunctional short interfering nucleic acids (multifunctional siNAs) can optionally include certain overlapping nucleotide sequence where such overlapping nucleotide sequence is present in between the first region and the second region of the multifunctional siNA (see for example FIGS. 18 and 19).

In one embodiment, the invention features a multifunctional short interfering nucleic acid (multifunctional siNA) molecule, wherein each strand of the multifunctional siNA independently comprises a first region of nucleic acid sequence that is complementary to a distinct target nucleic acid sequence and the second region of nucleotide sequence that is not complementary to the target sequence. The target nucleic acid sequence of each strand is in the same target nucleic acid molecule or different target nucleic acid molecules.

In another embodiment, the multifunctional siNA comprises two strands, where: (a) the first strand comprises a region having sequence complementarity to a target nucleic acid sequence (complementary region 1) and a region having no sequence complementarity to the target nucleotide sequence (non-complementary region 1); (b) the second strand of the multifunction siNA comprises a region having sequence complementarity to a target nucleic acid sequence that is distinct from the target nucleotide sequence complementary to the first strand nucleotide sequence (complementary region 2), and a region having no sequence complementarity to the target nucleotide sequence of complementary region 2 (non-complementary region 2); (c) the complementary region 1 of the first strand comprises a nucleotide sequence that is complementary to a nucleotide sequence in the non-complementary region 2 of the second strand and the complementary region 2 of the second strand comprises a nucleotide sequence that is complementary to a nucleotide sequence in the non-complementary region 1 of the first strand. The target nucleic acid sequence of complementary region 1 and complementary region 2 is in the same target nucleic acid molecule or different target nucleic acid molecules.

In another embodiment, the multifunctional siNA comprises two strands, where: (a) the first strand comprises a region having sequence complementarity to a target nucleic acid sequence derived from a gene (e.g., RSV or host gene) (complementary region 1) and a region having no sequence complementarity to the target nucleotide sequence of complementary region 1 (non-complementary region 1); (b) the second strand of the multifunction siNA comprises a region having sequence complementarity to a target nucleic acid sequence derived from a gene that is distinct from the gene of complementary region 1 (complementary region 2), and a region having no sequence complementarity to the target nucleotide sequence of complementary region 2 (non-complementary region 2); (c) the complementary region 1 of the first strand comprises a nucleotide sequence that is complementary to a nucleotide sequence in the non-complementary region 2 of the second strand and the complementary region 2 of the second strand comprises a nucleotide sequence that is complementary to a nucleotide sequence in the non-complementary region 1 of the first strand.

In another embodiment, the multifunctional siNA comprises two strands, where:
(a) the first strand comprises a region having sequence complementarity to a target nucleic acid sequence derived from a gene (e.g., RSV or host gene) (complementary region 1) and a region having no sequence complementarity to the target nucleotide sequence of complementary region 1 (non-complementary region 1); (b) the second strand of the multi-function siNA comprises a region having sequence complementarity to a target nucleic acid sequence distinct from the target nucleic acid sequence of complementary region 1 (complementary region 2), provided, however, that the target nucleic acid sequence for complementary region 1 and target nucleic acid sequence for complementary region 2 are both derived from the same gene, and a region having no sequence complementarity to the target nucleotide sequence of complementary region 2 (non-complementary region 2); (c) the complementary region 1 of the first strand comprises a nucleotide sequence that is complementary to a nucleotide sequence in the non-complementary region 2 of the second strand and the complementary region 2 of the second strand comprises a nucleotide sequence that is complementary to nucleotide sequence in the non-complementary region 1 of the first strand.

In one embodiment, the invention features a multifunctional short interfering nucleic acid (multifunctional siNA) molecule, wherein the multifunctional siNA comprises two complementary nucleic acid sequences in which the first sequence comprises a first region having nucleotide sequence complementary to nucleotide sequence within a first target nucleic acid molecule, and in which the second sequence comprises a first region having nucleotide sequence complementary to a distinct nucleotide sequence within the same target nucleic acid molecule. Preferably, the first region of the first sequence is also complementary to the nucleotide sequence of the second region of the second sequence, and where the first region of the second sequence is complementary to the nucleotide sequence of the second region of the first sequence.

In one embodiment, the invention features a multifunctional short interfering nucleic acid (multifunctional siNA) molecule, wherein the multifunctional siNA comprises two complementary nucleic acid sequences in which the first sequence comprises a first region having a nucleotide sequence complementary to a nucleotide sequence within a first target nucleic acid molecule, and in which the second sequence comprises a first region having a nucleotide sequence complementary to a distinct nucleotide sequence within a second target nucleic acid molecule. Preferably, the first region of the first sequence is also complementary to the nucleotide sequence of the second region of the second sequence, and where the first region of the second sequence is complementary to the nucleotide sequence of the second region of the first sequence.

In one embodiment, the invention features a multifunctional siNA molecule comprising a first region and a second region, where the first region comprises a nucleic acid sequence having about 18 to about 28 nucleotides complementary to a nucleic acid sequence within a first target nucleic acid molecule, and the second region comprises nucleotide sequence having about 18 to about 28 nucleotides complementary to a distinct nucleic acid sequence within a second target nucleic acid molecule.

In one embodiment, the invention features a multifunctional siNA molecule comprising a first region and a second region, where the first region comprises nucleic acid sequence having about 18 to about 28 nucleotides complementary to a nucleic acid sequence within a target nucleic acid molecule, and the second region comprises nucleotide sequence having about 18 to about 28 nucleotides complementary to a distinct nucleic acid sequence within the same target nucleic acid molecule.

In one embodiment, the invention features a double stranded multifunctional short interfering nucleic acid (multifunctional siNA) molecule, wherein one strand of the multifunctional siNA comprises a first region having nucleotide sequence complementary to a first target nucleic acid sequence, and the second strand comprises a first region having a nucleotide sequence complementary to a second target nucleic acid sequence. The first and second target nucleic acid sequences can be present in separate target nucleic acid molecules or can be different regions within the same target nucleic acid molecule. As such, multifunctional siNA molecules of the invention can be used to target the expression of different genes, splice variants of the same gene, both mutant and conserved regions of one or more gene transcripts, or both coding and non-coding sequences of the same or differing genes or gene transcripts.

In one embodiment, a target nucleic acid molecule of the invention encodes a single protein. In another embodiment, a target nucleic acid molecule encodes more than one protein (e.g., 1, 2, 3, 4, 5 or more proteins). As such, a multifunctional siNA construct of the invention can be used to down regulate or inhibit the expression of several proteins. For example, a multifunctional siNA molecule comprising a region in one strand having nucleotide sequence complementarity to a first target nucleic acid sequence derived from a viral genome (e.g., RSV) and the second strand comprising a region with nucleotide sequence complementarity to a second target nucleic acid sequence present in target nucleic acid molecules derived from genes encoding two proteins (e.g., two differing host proteins involved in the RSV life-cycle) can be used to down regulate, inhibit, or shut down a particular biologic pathway by targeting, for example, a viral RNA (e.g., RSV RNA) and one or more host RNAs that are involved in viral infection or the viral life-cycle (e.g., Rho-A, ICAM-1, or interferon regulatory factors).

In another non-limiting example, a multifunctional siNA molecule comprising a region in one strand having a nucleotide sequence complementarity to a first target nucleic acid sequence derived from a target nucleic acid molecule encoding a virus or a viral protein (e.g., RSV) and the second strand comprising a region having a nucleotide sequence complementarity to a second target nucleic acid sequence present in target nucleic acid molecule encoding a cellular protein (e.g., a host cell receptor for the virus) can be used to down regulate, inhibit, or shut down the viral replication and infection by targeting the virus and cellular proteins necessary for viral infection or replication.

In another nonlimiting example, a multifunctional siNA molecule comprising a region in one strand having a nucleotide sequence complementarity to a first target nucleic acid sequence (e.g., conserved sequence) present in a target nucleic acid molecule such as a viral genome (e.g., RSV RNA) and the second strand comprising a region having a nucleotide sequence complementarity to a second target nucleic acid sequence (e.g., conserved sequence) present in target nucleic acid molecule derived from a gene encoding a viral protein (e.g., RSV proteins) to down regulate, inhibit, or shut down the viral replication and infection by targeting the viral genome and viral encoded proteins necessary for viral infection or replication.

In one embodiment the invention takes advantage of conserved nucleotide sequences present in different strains, isotypes or forms of a virus and genes encoded by these different strains, isotypes and forms of the virus (e.g., RSV). By designing multifunctional siNAs in a manner where one strand includes a sequence that is complementary to target nucleic acid sequence conserved among various strains, isotypes or forms of a virus and the other strand includes sequence that is complementary to target nucleic acid sequence conserved in a protein encoded by the virus, it is possible to selectively and effectively inhibit viral replication or infection using a single multifunctional siNA.

In one embodiment, a multifunctional short interfering nucleic acid (multifunctional siNA) of the invention comprises a first region and a second region, wherein the first region comprises nucleotide sequence complementary to a RSV viral RNA of a first viral strain and the second region comprises nucleotide sequence complementary to a RSV viral RNA of a second viral strain. In one embodiment, the first and second regions can comprise nucleotide sequence complementary to shared or conserved RNA sequences of differing viral strains or classes or viral strains.

In one embodiment, a multifunctional short interfering nucleic acid (multifunctional siNA) of the invention comprises a first region and a second region, wherein the first region comprises a nucleotide sequence complementary to a RSV viral RNA encoding one or more RSV viruses (e.g., one or more strains of RSV) and the second region comprises a nucleotide sequence complementary to a viral RNA encoding one or more interferon agonist proteins. In one embodiment, the first region can comprise a nucleotide sequence complementary to shared or conserved RNA sequences of differing RSV viral strains or classes of RSV viral strains. Non-limiting example of interferon agonist proteins include any protein that is capable of inhibition or suppressing RNA silencing (e.g., RNA binding proteins such as E3L or NS1 or equivalents thereof.

In one embodiment, a multifunctional short interfering nucleic acid (multifunctional siNA) of the invention comprises a first region and a second region, wherein the first region comprises nucleotide sequence complementary to a RSV viral RNA and the second region comprises nucleotide sequence complementary to a cellular RNA that is involved in RSV viral infection and/or replication. Non-limiting examples of cellular RNAs involved in viral infection and/or replication include cellular receptors (see for example Ghildyal et al., 2005, J Gen Virol., 86: 1879-94), cell surface molecules, cellular enzymes, cellular transcription factors, and/or cytokines, second messengers, and cellular accessory molecules including, but not limited to, La antigen, FAS, interferon agonist protein, interferon regulatory factors (IRFs); cellular PKR protein kinase (PKR); human eukaryotic initiation factors 2B (elF2B gamma and/or elF2gamma); human DEAD Box protein (DDX3); and cellular proteins that bind to the poly(U) tract of the RSV 3'-UTR, such as polypyrimidine tract-binding protein.

In one embodiment, a double stranded multifunctional siNA molecule of the invention comprises a structure having Formula MF-I:

```
5'-p-X Z X'-3'

3'-Y' Z Y-p-5'
``` wherein each 5'-p-XZX'-3' and 5'-p-YZY'-3' are independently an oligonucleotide of length about 20 nucleotides to about 300 nucleotides, preferably about 20 to about 200 nucleotides, about 20 to about 100 nucleotides, about 20 to about 40 nucleotides, about 20 to about 40 nucleotides, about 24 to about 38 nucleotides, or about 26 to about 38 nucleotides; XZ comprises a nucleic acid sequence that is complementary to a first RSV target nucleic acid sequence; YZ is an oligonucleotide comprising nucleic acid sequence that is complementary to a second RSV target nucleic acid sequence; Z comprises nucleotide sequence of length about 1 to about 24 nucleotides (e.g., about 1, 2, 3, 4, 5, 6, 7, 8, 9, 10, 11, 12, 13, 14, 15, 16, 17, 18, 19, 20, 21, 22, 23, or 24 nucleotides) that is self complementary; X comprises nucleotide sequence of length about 1 to about 100 nucleotides, preferably about 1 to about 21 nucleotides (e.g., about 1, 2, 3, 4, 5, 6, 7, 8, 9, 10, 11, 12, 13, 14, 15, 16, 17, 18, 19, 20, or 21 nucleotides) that is complementary to nucleotide sequence present in region Y'; Y comprises nucleotide sequence of length about 1 to about 100 nucleotides, preferably about 1 to about 21 nucleotides (e.g., about 1, 2, 3, 4, 5, 6, 7, 8, 9, 10, 11, 12, 13, 14, 15, 16, 17, 18, 19, 20 or 21 nucleotides) that is complementary to nucleotide sequence present in region X'; each p comprises a terminal phosphate group that is independently present or absent; each XZ and YZ is independently of length sufficient to stably interact (i.e., base pair) with the first and second target nucleic acid sequence, respectively, or a portion thereof. For example, each sequence X and Y can independently comprise sequence from about 12 to about 21 or more nucleotides in length (e.g., about 12, 13, 14, 15, 16, 17, 18, 19, 20, 21, or more) that is complementary to a target nucleotide sequence in different target nucleic acid molecules, such as target RNAs or a portion thereof. In another non-limiting example, the length of the nucleotide sequence of X and Z together that is complementary to the first RSV target nucleic acid sequence or a portion thereof is from about 12 to about 21 or more nucleotides (e.g., about 12, 13, 14, 15, 16, 17, 18, 19, 20, 21, or more). In another non-limiting example, the length of the nucleotide sequence of Y and Z together, that is complementary to the second RSV target nucleic acid sequence or a portion thereof is from about 12 to about 21 or more nucleotides (e.g., about 12, 13, 14, 15, 16, 17, 18, 19, 20, 21, or more). In one embodiment, the first RSV target nucleic acid sequence and the second RSV target nucleic acid sequence are present in the same target nucleic acid molecule (e.g., RSV RNA or host RNA). In another embodiment, the first RSV target nucleic acid sequence and the second RSV target nucleic acid sequence are present in different target nucleic acid molecules (e.g., RSV RNA and host RNA). In one embodiment, Z comprises a palindrome or a repeat sequence. In one embodiment, the lengths of oligonucleotides X and X' are identical. In another embodiment, the lengths of oligonucleotides X and X' are not identical. In one embodiment, the lengths of oligonucleotides Y and Y' are identical. In another embodiment, the lengths of oligonucleotides Y and Y' are not identical. In one embodiment, the double stranded oligonucleotide construct of Formula I(a) includes one or more, specifically 1, 2, 3 or 4, mismatches, to the extent such mismatches do not significantly diminish the ability of the double stranded oligonucleotide to inhibit target gene expression.

In one embodiment, a multifunctional siNA molecule of the invention comprises a structure having Formula MF-II:

```
5'-p-X X'-3'

3'-Y' Y-p-5'
``` wherein each 5'-p-XX'-3' and 5'-p-YY'-3' are independently an oligonucleotide of length about 20 nucleotides to about 300 nucleotides, preferably about 20 to about 200 nucleotides, about 20 to about 100 nucleotides, about 20 to about 40 nucleotides, about 20 to about 40 nucleotides, about 24 to about 38 nucleotides, or about 26 to about 38 nucleotides; X comprises a nucleic acid sequence that is complementary to a first target nucleic acid sequence; Y is an oligonucleotide comprising nucleic acid sequence that is complementary to a second target nucleic acid sequence; X comprises a nucleotide sequence of length about 1 to about 100 nucleotides, preferably about 1 to about 21 nucleotides (e.g., about 1, 2, 3, 4, 5, 6, 7, 8, 9, 10, 11, 12, 13, 14, 15, 16, 17, 18, 19, 20, or 21 nucleotides) that is complementary to nucleotide sequence present in region Y'; Y comprises nucleotide sequence of length about 1 to about 100 nucleotides, preferably about 1 to about 21 nucleotides (e.g., about 1, 2, 3, 4, 5, 6, 7, 8, 9, 10, 11, 12, 13, 14, 15, 16, 17, 18, 19, 20 or 21 nucleotides) that is complementary to nucleotide sequence present in region X'; each p comprises a terminal phosphate group that is independently present or absent; each X and Y independently is of length sufficient to stably interact (i.e., base pair) with the first and second target nucleic acid sequence, respectively, or a portion thereof. For example, each sequence X and Y can independently comprise sequence from about 12 to about 21 or more nucleotides in length (e.g., about 12, 13, 14, 15, 16, 17, 18, 19, 20, 21, or more) that is complementary to a target nucleotide sequence in different target nucleic acid molecules, such as RSV target RNAs or a portion thereof. In one embodiment, the first RSV target nucleic acid sequence and the second RSV target nucleic acid sequence are present in the same target nucleic acid molecule (e.g., RSV RNA or host RNA). In another embodiment, the first RSV target nucleic acid sequence and the second RSV target nucleic acid sequence are present in different target nucleic acid molecules (e.g., RSV RNA and host RNA). In one embodiment, Z comprises a palindrome or a repeat sequence. In one embodiment, the lengths of oligonucleotides X and X' are identical. In another embodiment, the lengths of oligonucleotides X and X' are not identical. In one embodiment, the lengths of oligonucleotides Y and Y' are identical. In another embodiment, the lengths of oligonucleotides Y and Y' are not identical. In one embodiment, the double stranded oligonucleotide construct of Formula I(a) includes one or more, specifically 1, 2, 3 or 4, mismatches, to the extent such mismatches do not significantly diminish the ability of the double stranded oligonucleotide to inhibit target gene expression.

In one embodiment, a multifunctional siNA molecule of the invention comprises a structure having Formula MF-III:

wherein each X, X', Y, and Y' is independently an oligonucleotide of length about 15 nucleotides to about 50 nucleotides, preferably about 18 to about 40 nucleotides, or about 19 to about 23 nucleotides; X comprises nucleotide sequence that is complementary to nucleotide sequence present in region Y'; X' comprises nucleotide sequence that is complementary to nucleotide sequence present in region Y; each X and X' is independently of length sufficient to stably interact (i.e., base pair) with a first and a second RSV target nucleic acid sequence, respectively, or a portion thereof; W represents a nucleotide or non-nucleotide linker that connects sequences Y' and Y; and the multifunctional siNA directs cleavage of the first and second RSV target sequence via RNA interference. In one embodiment, the first RSV target nucleic acid sequence and the second RSV target nucleic acid sequence are present in the same target nucleic acid molecule (e.g., RSV RNA or host RNA). In another embodiment, the first RSV target nucleic acid sequence and the second RSV target nucleic acid sequence are present in different target nucleic acid molecules (e.g., RSV RNA and host RNA). In one embodiment, region W connects the 3'-end of sequence Y' with the 3'-end of sequence Y. In one embodiment, region W connects the 3'-end of sequence Y' with the 5'-end of sequence Y. In one embodiment, region W connects the 5'-end of sequence Y' with the 5'-end of sequence Y. In one embodiment, region W connects the 5'-end of sequence Y' with the 3'-end of sequence Y. In one embodiment, a terminal phosphate group is present at the 5'-end of sequence X. In one embodiment, a terminal phosphate group is present at the 5'-end of sequence X'. In one embodiment, a terminal phosphate group is present at the 5'-end of sequence Y. In one embodiment, a terminal phosphate group is present at the 5'-end of sequence Y'. In one embodiment, W connects sequences Y and Y' via a biodegradable linker. In one embodiment, W further comprises a conjugate, label, aptamer, ligand, lipid, or polymer.

In one embodiment, a multifunctional siNA molecule of the invention comprises a structure having Formula MF-IV:

wherein each X, X', Y, and Y' is independently an oligonucleotide of length about 15 nucleotides to about 50 nucleotides, preferably about 18 to about 40 nucleotides, or about 19 to about 23 nucleotides; X comprises nucleotide sequence that is complementary to nucleotide sequence present in region Y'; X' comprises nucleotide sequence that is complementary to nucleotide sequence present in region Y; each Y and Y' is independently of length sufficient to stably interact (i.e., base pair) with a first and a second RSV target nucleic acid sequence, respectively, or a portion thereof; W represents a nucleotide or non-nucleotide linker that connects sequences Y' and Y; and the multifunctional siNA directs cleavage of the first and second RSV target sequence via RNA interference. In one embodiment, the first RSV target nucleic acid sequence and the second RSV target nucleic acid sequence are present in the same target nucleic acid molecule (e.g., RSV RNA or host RNA). In another embodiment, the first RSV target nucleic acid sequence and the second RSV target nucleic acid sequence are present in different target nucleic acid molecules (e.g., RSV RNA and host RNA). In one embodiment, region W connects the 3'-end of sequence Y' with the 3'-end of sequence Y. In one embodiment, region W connects the 3'-end of sequence Y' with the 5'-end of sequence Y. In one embodiment, region W connects the 5'-end of sequence Y' with the 5'-end of sequence Y. In one embodiment, region W connects the 5'-end of sequence Y' with the 3'-end of sequence Y. In one embodiment, a terminal phosphate group is present at the 5'-end of sequence X. In one embodiment, a terminal phosphate group is present at the 5'-end of sequence X'. In one embodiment, a terminal phosphate group is present at the 5'-end of sequence Y. In one embodiment, a terminal phosphate group is present at the 5'-end of sequence Y'. In one embodiment, W connects sequences Y and Y' via a biodegradable linker. In one embodiment, W further comprises a conjugate, label, aptamer, ligand, lipid, or polymer.

In one embodiment, a multifunctional siNA molecule of the invention comprises a structure having Formula MF-V:

wherein each X, X', Y, and Y' is independently an oligonucleotide of length about 15 nucleotides to about 50 nucleotides, preferably about 18 to about 40 nucleotides, or about 19 to about 23 nucleotides; X comprises nucleotide sequence that is complementary to nucleotide sequence present in region Y'; X' comprises nucleotide sequence that is complementary to nucleotide sequence present in region Y; each X, X', Y, or Y' is independently of length sufficient to stably interact (i.e., base pair) with a first, second, third, or fourth RSV target nucleic acid sequence, respectively, or a portion thereof; W represents a nucleotide or non-nucleotide linker that connects sequences Y' and Y; and the multifunctional siNA directs cleavage of the first, second, third, and/or fourth target sequence via RNA interference. In one embodiment, the first, second, third and fourth RSV target nucleic acid sequence are all present in the same target nucleic acid molecule (e.g., RSV RNA or host RNA). In another embodiment, the first, second, third and fourth RSV target nucleic acid sequence are independently present in different target nucleic acid molecules (e.g., RSV RNA and host RNA). In one embodiment, region W connects the 3'-end of sequence Y' with the 3'-end of sequence Y. In one embodiment, region W connects the 3'-end of sequence Y' with the 5'-end of sequence Y. In one embodiment, region W connects the 5'-end of sequence Y' with the 5'-end of sequence Y. In one embodiment, region W connects the 5'-end of sequence Y' with the 3'-end of sequence Y. In one embodiment, a terminal phosphate group is present at the 5'-end of sequence X. In one embodiment, a terminal phosphate group is present at the 5'-end of sequence X'. In one embodiment, a terminal phosphate group is present at the 5'-end of sequence Y. In one embodiment, a terminal phosphate group is present at the 5'-end of sequence Y'. In one embodiment, W connects sequences Y and Y' via a biodegradable linker. In one embodiment, W further comprises a conjugate, label, aptamer, ligand, lipid, or polymer.

In one embodiment, regions X and Y of multifunctional siNA molecule of the invention (e.g., having any of Formula MF-I-MF-V), are complementary to different target nucleic acid sequences that are portions of the same target nucleic acid molecule. In one embodiment, such target nucleic acid sequences are at different locations within the coding region of a RNA transcript. In one embodiment, such target nucleic acid sequences comprise coding and non-coding regions of the same RNA transcript. In one embodiment, such target nucleic acid sequences comprise regions of alternately spliced transcripts or precursors of such alternately spliced transcripts.

In one embodiment, a multifunctional siNA molecule having any of Formula MF-I-MF-V can comprise chemical modifications as described herein without limitation, such as, for example, nucleotides having any of Formulae I-VII described herein, stabilization chemistries as described in Table IV, or any other combination of modified nucleotides and non-nucleotides as described in the various embodiments herein.

In one embodiment, the palindrome or repeat sequence or modified nucleotide (e.g., nucleotide with a modified base, such as 2-amino purine or a universal base) in Z of multifunctional siNA constructs having Formula MF-I or MF-II comprises chemically modified nucleotides that are able to interact with a portion of the target nucleic acid sequence (e.g., modified base analogs that can form Watson Crick base pairs or non-Watson Crick base pairs).

In one embodiment, a multifunctional siNA molecule of the invention, for example each strand of a multifunctional siNA having MF-I-MF-V, independently comprises about 15 to about 40 nucleotides (e.g., about 15, 16, 17, 18, 19, 20, 21, 22, 23, 24, 25, 26, 27, 28, 29, 30, 31, 32, 33, 34, 35, 36, 37, 38, 39, or 40 nucleotides). In one embodiment, a multifunctional siNA molecule of the invention comprises one or more chemical modifications. In a non-limiting example, the introduction of chemically modified nucleotides and/or non-nucleotides into nucleic acid molecules of the invention provides a powerful tool in overcoming potential limitations of in vivo stability and bioavailability inherent to unmodified RNA molecules that are delivered exogenously. For example, the use of chemically modified nucleic acid molecules can enable a lower dose of a particular nucleic acid molecule for a given therapeutic effect since chemically modified nucleic acid molecules tend to have a longer half-life in serum or in cells or tissues. Furthermore, certain chemical modifications can improve the bioavailability and/or potency of nucleic acid molecules by not only enhancing half-life but also facilitating the targeting of nucleic acid molecules to particular organs, cells or tissues and/or improving cellular uptake of the nucleic acid molecules. Therefore, even if the activity of a chemically modified nucleic acid molecule is reduced in vitro as compared to a native/unmodified nucleic acid molecule, for example when compared to an unmodified RNA molecule, the overall activity of the modified nucleic acid molecule can be greater than the native or unmodified nucleic acid molecule due to improved stability, potency, duration of effect, bioavailability and/or delivery of the molecule.

In another embodiment, the invention features multifunctional siNAs, wherein the multifunctional siNAs are assembled from two separate double-stranded siNAs, with one of the ends of each sense strand is tethered to the end of the sense strand of the other siNA molecule, such that the two antisense siNA strands are annealed to their corresponding sense strand that are tethered to each other at one end (see FIG. 22). The tethers or linkers can be nucleotide-based linkers or non-nucleotide based linkers as generally known in the art and as described herein.

In one embodiment, the invention features a multifunctional siNA, wherein the multifunctional siNA is assembled from two separate double-stranded siNAs, with the 5'-end of one sense strand of the siNA is tethered to the 5'-end of the sense strand of the other siNA molecule, such that the 5'-ends of the two antisense siNA strands, annealed to their corresponding sense strand that are tethered to each other at one end, point away (in the opposite direction) from each other (see FIG. 22 (A)). The tethers or linkers can be nucleotide-based linkers or non-nucleotide based linkers as generally known in the art and as described herein.

In one embodiment, the invention features a multifunctional siNA, wherein the multifunctional siNA is assembled from two separate double-stranded siNAs, with the 3'-end of one sense strand of the siNA is tethered to the 3'-end of the sense strand of the other siNA molecule, such that the 5'-ends of the two antisense siNA strands, annealed to their corresponding sense strand that are tethered to each other at one end, face each other (see FIG. 22 (B)). The tethers or linkers can be nucleotide-based linkers or non-nucleotide based linkers as generally known in the art and as described herein.

In one embodiment, the invention features a multifunctional siNA, wherein the multifunctional siNA is assembled from two separate double-stranded siNAs, with the 5'-end of one sense strand of the siNA is tethered to the 3'-end of the sense strand of the other siNA molecule, such that the 5'-end of the one of the antisense siNA strands annealed to their corresponding sense strand that are tethered to each other at one end, faces the 3'-end of the other antisense strand (see FIG. 22 (C-D)). The tethers or linkers can be nucleotide-based linkers or non-nucleotide based linkers as generally known in the art and as described herein.

In one embodiment, the invention features a multifunctional siNA, wherein the multifunctional siNA is assembled from two separate double-stranded siNAs, with the 5'-end of one antisense strand of the siNA is tethered to the 3'-end of the antisense strand of the other siNA molecule, such that the 5'-end of the one of the sense siNA strands annealed to their corresponding antisense sense strand that are tethered to each other at one end, faces the 3'-end of the other sense strand (see FIG. 22 (G-H)). In one embodiment, the linkage between the 5'-end of the first antisense strand and the 3'-end of the second antisense strand is designed in such a way as to be readily cleavable (e.g., biodegradable linker) such that the 5' end of each antisense strand of the multifunctional siNA has a free 5'-end suitable to mediate RNA interference-based cleavage of the target RNA. The tethers or linkers can be nucleotide-based linkers or non-nucleotide based linkers as generally known in the art and as described herein.

In one embodiment, the invention features a multifunctional siNA, wherein the multifunctional siNA is assembled from two separate double-stranded siNAs, with the 5'-end of one antisense strand of the siNA is tethered to the 5'-end of the antisense strand of the other siNA molecule, such that the 3'-end of the one of the sense siNA strands annealed to their corresponding antisense sense strand that are tethered to each other at one end, faces the 3'-end of the other sense strand (see FIG. 22 (E)). In one embodiment, the linkage between the 5'-end of the first antisense strand and the 5'-end of the second antisense strand is designed in such a way as to be readily cleavable (e.g., biodegradable linker) such that the 5' end of each antisense strand of the multifunctional siNA has a free 5'-end suitable to mediate RNA interference-based cleavage of the target RNA. The tethers or linkers can be nucleotide-based linkers or non-nucleotide based linkers as generally known in the art and as described herein.

In one embodiment, the invention features a multifunctional siNA, wherein the multifunctional siNA is assembled from two separate double-stranded siNAs, with the 3'-end of one antisense strand of the siNA is tethered to the 3'-end of the antisense strand of the other siNA molecule, such that the 5'-end of the one of the sense siNA strands annealed to their corresponding antisense sense strand that are tethered to each other at one end, faces the 3'-end of the other sense strand (see FIG. 22 (F)). In one embodiment, the linkage between the 5'-end of the first antisense strand and the 5'-end of the second antisense strand is designed in such a way as to be readily cleavable (e.g., biodegradable linker) such that the 5' end of each antisense strand of the multifunctional siNA has a free 5'-end suitable to mediate RNA interference-based cleavage of the target RNA. The tethers or linkers can be nucleotide-based linkers or non-nucleotide based linkers as generally known in the art and as described herein.

In any of the above embodiments, a first target nucleic acid sequence or second target nucleic acid sequence can independently comprise RSV RNA or a portion thereof or a polynucleotide coding or non-coding sequence of cellular or host target that is involved in RSV infection or replication, or disease processes associated with RSV infection such as such as cellular receptors, cell surface molecules, cellular enzymes, cellular transcription factors, and/or cytokines, second messengers, and cellular accessory molecules including, but not limited to, ICAM-1, RhoA (see for example Budge et al., 2004, Journal of Antimicrobial Chemotherapy, 54(2): 299-302, Genbank Accession No. NM_044472); FAS (e.g., Genbank Accession No. NM_000043) or FAS ligand (e.g., Genbank Accession No. NM_000639); interferon regulatory factors (IRFs; e.g., Genbank Accession No. AF082503.1); cellular PKR protein kinase (e.g., Genbank Accession No. XM_002661.7); human eukaryotic initiation factors 2B (eIF2Bgamma; e.g., Genbank Accession No. AF256223, and/or eIF2gamma; e.g., Genbank Accession No. NM_006874.1); human DEAD Box protein (DDX3; e.g., Genbank Accession No. XM_018021.2); and cellular proteins that bind to the poly(U) tract of the RSV 3'-UTR, such as polypyrimidine tract-binding protein (e.g., Genbank Accession Nos. NM_031991.1 and XM_042972.3). In one embodiment, the first RSV target nucleic acid sequence is a RSV RNA or a portion thereof and the second RSV target nucleic acid sequence is a RSV RNA of a portion thereof. In one embodiment, the first RSV target nucleic acid sequence is a RSV RNA or a portion thereof and the second RSV target nucleic acid sequence is a host RNA or a portion thereof. In one embodiment, the first RSV target nucleic acid sequence is a host RNA or a portion thereof and the second RSV target nucleic acid sequence is a host RNA or a portion thereof. In one embodiment, the first RSV target nucleic acid sequence is a host RNA or a portion thereof and the second RSV target nucleic acid sequence is a RSV RNA or a portion thereof.

Synthesis of Nucleic Acid Molecules

Synthesis of nucleic acids greater than 100 nucleotides in length is difficult using automated methods, and the therapeutic cost of such molecules is prohibitive. In this invention, small nucleic acid motifs ("small" refers to nucleic acid motifs no more than 100 nucleotides in length, preferably no more than 80 nucleotides in length, and most preferably no more than 50 nucleotides in length; e.g., individual siNA oligonucleotide sequences or siNA sequences synthesized in tandem) are preferably used for exogenous delivery. The simple structure of these molecules increases the ability of the nucleic acid to invade targeted regions of protein and/or RNA structure. Exemplary molecules of the instant invention are chemically synthesized, and others can similarly be synthesized.

Oligonucleotides (e.g., certain modified oligonucleotides or portions of oligonucleotides lacking ribonucleotides) are synthesized using protocols known in the art, for example as described in Caruthers et al., 1992, *Methods in Enzymology* 211, 3-19, Thompson et al., International PCT Publication No. WO 99/54459, Wincott et al., 1995, *Nucleic Acids Res.* 23, 2677-2684, Wincott et al., 1997, *Methods Mol. Bio.*, 74, 59, Brennan et al., 1998, *Biotechnol Bioeng.*, 61, 33-45, and Brennan, U.S. Pat. No. 6,001,311. All of these references are incorporated herein by reference. The synthesis of oligonucleotides makes use of common nucleic acid protecting and coupling groups, such as dimethoxytrityl at the 5'-end, and phosphoramidites at the 3'-end. In a non-limiting example, small scale syntheses are conducted on a 394 Applied Biosystems, Inc. synthesizer using a 0.2 µmol scale protocol with a 2.5 min coupling step for 2'-O-methylated nucleotides and a 45 second coupling step for 2'-deoxy nucleotides or 2'-deoxy-2'-fluoro nucleotides. Table V outlines the amounts and the contact times of the reagents used in the synthesis cycle. Alternatively, syntheses at the 0.2 µmol scale can be performed on a 96-well plate synthesizer, such as the instrument produced by Protogene (Palo Alto, Calif.) with minimal modification to the cycle. A 33-fold excess (60 µL of 0.11 M=6.6 µmol) of 2'-O-methyl phosphoramidite and a 105-fold excess of S-ethyl tetrazole (60 µL of 0.25 M=15 µmol) can be used in each coupling cycle of 2'-O-methyl residues relative to polymer-bound 5'-hydroxyl. A 22-fold excess (40 µL of 0.11 M=4.4 µmol) of deoxy phosphoramidite and a 70-fold excess of S-ethyl tetrazole (40 µL of 0.25 M=10 µmol) can be used in each coupling cycle of deoxy residues relative to polymer-bound 5'-hydroxyl. Average coupling yields on the 394 Applied Biosystems, Inc. synthesizer, determined by colorimetric quantitation of the trityl fractions, are typically 97.5-99%. Other oligonucleotide synthesis reagents for the 394 Applied Biosystems, Inc. synthesizer include the following: detritylation solution is 3% TCA in methylene chloride (ABI); capping is performed with 16% N-methyl imidazole in THF (ABI) and 10% acetic anhydride/10% 2,6-lutidine in THF (ABI); and oxidation solution is 16.9 mM $I_2$, 49 mM pyridine, 9% water in THF (PerSeptive Biosystems, Inc.). Burdick & Jackson Synthesis Grade acetonitrile is used directly from the reagent bottle. S-Ethyltetrazole solution (0.25 M in acetonitrile) is made up from the solid obtained from American International Chemical, Inc. Alternately, for the introduction of phosphorothioate linkages, Beaucage reagent (3H-1,2-Benzodithiol-3-one 1,1-dioxide, 0.05 M in acetonitrile) is used.

Deprotection of the DNA-based oligonucleotides is performed as follows: the polymer-bound trityl-on oligoribonucleotide is transferred to a 4 mL glass screw top vial and suspended in a solution of 40% aqueous methylamine (1 mL) at 65° C. for 10 minutes. After cooling to –20° C., the supernatant is removed from the polymer support. The support is washed three times with 1.0 mL of EtOH:MeCN:H2O/3:1:1, vortexed and the supernatant is then added to the first supernatant. The combined supernatants, containing the oligoribonucleotide, are dried to a white powder. In one embodiment, the nucleic acid molecules of the invention are synthesized, deprotected, and analyzed according to methods described in U.S. Pat. Nos. 6,995,259, 6,686,463, 6,673,918, 6,649,751, 6,989,442, and U.S. Ser. No. 10/190,359, all incorporated by reference herein in their entirety.

The method of synthesis used for RNA including certain siNA molecules of the invention follows the procedure as described in Usman et al., 1987, *J. Am. Chem. Soc.*, 109, 7845; Scaringe et al., 1990, *Nucleic Acids Res.*, 18, 5433; and Wincott et al., 1995, *Nucleic Acids Res.* 23, 2677-2684 Wincott et al., 1997, *Methods Mol. Bio.*, 74, 59, and makes use of common nucleic acid protecting and coupling groups, such as dimethoxytrityl at the 5'-end, and phosphoramidites at the 3'-end. In a non-limiting example, small scale syntheses are conducted on a 394 Applied Biosystems, Inc. synthesizer using a 0.2 µmol scale protocol with a 7.5 min coupling step for alkylsilyl protected nucleotides and a 2.5 min coupling step for 2'-O-methylated nucleotides. Table V outlines the amounts and the contact times of the reagents used in the synthesis cycle. Alternatively, syntheses at the 0.2 µmol scale can be done on a 96-well plate synthesizer, such as the instrument produced by Protogene (Palo Alto, Calif.) with minimal modification to the cycle. A 33-fold excess (60 µL of 0.11 M=6.6 µmol) of 2'-O-methyl phosphoramidite and a 75-fold excess of S-ethyl tetrazole (60 µL of 0.25 M=15 µmol) can be used in each coupling cycle of 2'-O-methyl residues relative to polymer-bound 5'-hydroxyl. A 66-fold excess (120 µL of 0.11 M=13.2 µmol) of alkylsilyl (ribo) protected phosphoramidite and a 150-fold excess of S-ethyl tetrazole (120 µL of 0.25 M=30 µmol) can be used in each coupling cycle of ribo residues relative to polymer-bound 5'-hydroxyl. Average coupling yields on the 394 Applied Biosystems, Inc. synthesizer, determined by colorimetric quantitation of the trityl fractions, are typically 97.5-99%. Other oligonucleotide synthesis reagents for the 394 Applied Biosystems, Inc. synthesizer include the following: detritylation solution is 3% TCA in methylene chloride (ABI); capping is performed with 16% N-methyl imidazole in THF (ABI) and 10% acetic anhydride/10% 2,6-lutidine in THF (ABI); oxidation solution is 16.9 mM $I_2$, 49 mM pyridine, 9% water in THF (PerSeptive Biosystems, Inc.). Burdick & Jackson Synthesis Grade acetonitrile is used directly from the reagent bottle. S-Ethyltetrazole solution (0.25 M in acetonitrile) is made up from the solid obtained from American International Chemical, Inc. Alternately, for the introduction of phosphorothioate linkages, Beaucage reagent (3H-1,2-Benzodithiol-3-one 1,1-dioxide0.05 M in acetonitrile) is used.

Deprotection of the RNA is performed using either a two-pot or one-pot protocol. For the two-pot protocol, the polymer-bound trityl-on oligoribonucleotide is transferred to a 4 mL glass screw top vial and suspended in a solution of 40% aq. methylamine (1 mL) at 65° C. for 10 min. After cooling to –20° C., the supernatant is removed from the polymer support. The support is washed three times with 1.0 mL of EtOH:MeCN:H2O/3:1:1, vortexed and the supernatant is then added to the first supernatant. The combined supernatants, containing the oligoribonucleotide, are dried to a white powder. The base deprotected oligoribonucleotide is resuspended in anhydrous TEA/HF/NMP solution (300 µL of a solution of 1.5 mL N-methylpyrrolidinone, 750 µL TEA and 1 mL TEA•3HF to provide a 1.4 M HF concentration) and heated to 65° C. After 1.5 h, the oligomer is quenched with 1.5 M $NH_4HCO_3$. In one embodiment, the nucleic acid molecules of the invention are synthesized, deprotected, and analyzed according to methods described in U.S. Pat. Nos. 6,995,259, 6,686,463, 6,673,918, 6,649,751, 6,989,442, and U.S. Ser. No. 10/190,359, all incorporated by reference herein in their entirety.

Alternatively, for the one-pot protocol, the polymer-bound trityl-on oligoribonucleotide is transferred to a 4 mL glass screw top vial and suspended in a solution of 33% ethanolic methylamine/DMSO:1/1 (0.8 mL) at 65° C. for 15 minutes. The vial is brought to room temperature TEA•3HF (0.1 mL) is added and the vial is heated at 65° C. for 15 minutes. The sample is cooled at –20° C. and then quenched with 1.5 M $NH_4HCO_3$.

For purification of the trityl-on oligomers, the quenched $NH_4HCO_3$ solution is loaded onto a C-18 containing cartridge that had been prewashed with acetonitrile followed by 50 mM TEAA. After washing the loaded cartridge with water, the RNA is detritylated with 0.5% TFA for 13 minutes. The cartridge is then washed again with water, salt exchanged with 1 M NaCl and washed with water again. The oligonucleotide is then eluted with 30% acetonitrile.

The average stepwise coupling yields are typically >98% (Wincott et al., 1995 *Nucleic Acids Res.* 23, 2677-2684). Those of ordinary skill in the art will recognize that the scale of synthesis can be adapted to be larger or smaller than the example described above including but not limited to 96-well format.

Alternatively, the nucleic acid molecules of the present invention can be synthesized separately and joined together post-synthetically, for example, by ligation (Moore et al., 1992, *Science* 256, 9923; Draper et al., International PCT publication No. WO 93/23569; Shabarova et al., 1991, *Nucleic Acids Research* 19, 4247; Bellon et al., 1997, *Nucleosides & Nucleotides,* 16, 951; Bellon et al., 1997, *Bioconjugate Chem.* 8, 204), or by hybridization following synthesis and/or deprotection.

The siNA molecules of the invention can also be synthesized via a tandem synthesis methodology as described in Example 1 herein, wherein both siNA strands are synthesized as a single contiguous oligonucleotide fragment or strand separated by a cleavable linker which is subsequently cleaved to provide separate siNA fragments or strands that hybridize and permit purification of the siNA duplex. The linker can be a polynucleotide linker or a non-nucleotide linker. The tandem synthesis of siNA as described herein can be readily adapted to both multiwell/multiplate synthesis platforms such as 96 well or similarly larger multi-well platforms. The tandem synthesis of siNA as described herein can also be readily adapted to large scale synthesis platforms employing batch reactors, synthesis columns and the like.

A siNA molecule can also be assembled from two distinct nucleic acid strands or fragments wherein one fragment includes the sense region and the second fragment includes the antisense region of the RNA molecule.

The nucleic acid molecules of the present invention can be modified extensively to enhance stability by modification with nuclease resistant groups, for example, 2'-amino, 2'-C-allyl, 2'-fluoro, 2'-O-methyl, 2'-H (for a review see Usman and Cedergren, 1992, *TIBS* 17, 34; Usman et al., 1994, *Nucleic Acids Symp. Ser.* 31, 163). siNA constructs can be purified by gel electrophoresis using general methods or can be purified by high pressure liquid chromatography (HPLC; see Wincott et al., supra, the totality of which is hereby incorporated herein by reference) and re-suspended in water.

In another aspect of the invention, siNA molecules of the invention are expressed from transcription units inserted into DNA or RNA vectors. The recombinant vectors can be DNA plasmids or viral vectors. siNA expressing viral vectors can be constructed based on, but not limited to, adeno-associated virus, retrovirus, adenovirus, or alphavirus. The recombinant vectors capable of expressing the siNA molecules can be delivered as described herein, and persist in target cells. Alternatively, viral vectors can be used that provide for transient expression of siNA molecules.

Optimizing Activity of the Nucleic Acid Molecule of the Invention.

Chemically synthesizing nucleic acid molecules with modifications (base, sugar and/or phosphate) can prevent their degradation by serum ribonucleases, which can increase their potency (see e.g., Eckstein et al., International Publication No. WO 92/07065; Perrault et al., 1990 Nature 344, 565; Pieken et al., 1991, *Science* 253, 314; Usman and Cedergren, 1992, *Trends in Biochem. Sci.* 17, 334; Usman et al., International Publication No. WO 93/15187; and Rossi et al., International Publication No. WO 91/03162; Sproat, U.S. Pat. No. 5,334,711; Gold et al., U.S. Pat. No. 6,300,074; and Burgin et al., supra; all of which are incorporated by reference herein). All of the above references describe various chemical modifications that can be made to the base, phosphate and/or sugar moieties of the nucleic acid molecules described herein. Modifications that enhance their efficacy in cells, and removal of bases from nucleic acid molecules to shorten oligonucleotide synthesis times and reduce chemical requirements are desired.

There are several examples in the art describing sugar, base and phosphate modifications that can be introduced into nucleic acid molecules with significant enhancement in their nuclease stability and efficacy. For example, oligonucleotides are modified to enhance stability and/or enhance biological activity by modification with nuclease resistant groups, for example, 2'-amino, 2'-C-allyl, 2'-fluoro, 2'-O-methyl, 2'-O-allyl, 2'-H, nucleotide base modifications (for a review see Usman and Cedergren, 1992, *TIBS*. 17, 34; Usman et al., 1994, *Nucleic Acids Symp. Ser.* 31, 163; Burgin et al., 1996, *Biochemistry*, 35, 14090). Sugar modification of nucleic acid molecules have been extensively described in the art (see Eckstein et al., International Publication PCT No. WO 92/07065; Perrault et al. Nature, 1990, 344, 565-568; Pieken et al. Science, 1991, 253, 314-317; Usman and Cedergren, et al. Science, 1991, 253, 314-317; Usman and Cedergren, *Trends in Biochem. Sci.*, 1992, 17, 334-339; Usman et al. International Publication PCT No. WO 93/15187; Sproat, U.S. Pat. No. 5,334,711 and Beigelman et al., 1995, *J. Biol. Chem.*, 270, 25702; Beigelman et al., International PCT publication No. WO 97/26270; Beigelman et al., U.S. Pat. No. 5,716,824; Usman et al., U.S. Pat. No. 5,627,053; Woolf et al., International PCT Publication No. WO 98/13526; Thompson et al., U.S. Ser. No. 60/082,404 which was filed on Apr. 20, 1998; Karpeisky et al., 1998, *Tetrahedron Lett.*, 39, 1131; Earnshaw and Gait, 1998, *Biopolymers* (*Nucleic Acid Sciences*), 48, 39-55; Verma and Eckstein, 1998, *Annu. Rev. Biochem.*, 67, 99-134; and Burlina et al., 1997, *Bioorg. Med. Chem.*, 5, 1999-2010; all of the references are hereby incorporated in their totality by reference herein). Such publications describe general methods and strategies to determine the location of incorporation of sugar, base and/or phosphate modifications and the like into nucleic acid molecules without modulating catalysis, and are incorporated by reference herein. In view of such teachings, similar modifications can be used as described herein to modify the siNA nucleic acid molecules of the instant invention so long as the ability of siNA to promote RNAi is cells is not significantly inhibited.

In one embodiment, a nucleic acid molecule of the invention is chemically modified as described in US 20050020521, incorporated by reference herein in its entirety.

While chemical modification of oligonucleotide internucleotide linkages with phosphorothioate, phosphorodithioate, and/or 5'-methylphosphonate linkages improves stability, excessive modifications can cause some toxicity or decreased activity. Therefore, when designing nucleic acid molecules, the amount of these internucleotide linkages should be minimized. The reduction in the concentration of these linkages should lower toxicity, resulting in increased efficacy and higher specificity of these molecules.

Short interfering nucleic acid (siNA) molecules having chemical modifications that maintain or enhance activity are provided. Such a nucleic acid is also generally more resistant to nucleases than an unmodified nucleic acid. Accordingly, the in vitro and/or in vivo activity should not be significantly lowered. In cases in which modulation is the goal, therapeutic nucleic acid molecules delivered exogenously should optimally be stable within cells until translation of the target RNA has been modulated long enough to reduce the levels of the undesirable protein. This period of time varies between hours to days depending upon the disease state. Improvements in the chemical synthesis of RNA and DNA (Wincott et al., 1995, *Nucleic Acids Res.* 23, 2677; Caruthers et al., 1992, *Methods in Enzymology* 211, 3-19 (incorporated by reference herein)) have expanded the ability to modify nucleic acid molecules by introducing nucleotide modifications to enhance their nuclease stability, as described above.

In one embodiment, nucleic acid molecules of the invention include one or more (e.g., about 1, 2, 3, 4, 5, 6, 7, 8, 9, 10, or more) G-clamp nucleotides. A G-clamp nucleotide is a modified cytosine analog wherein the modifications confer the ability to hydrogen bond both Watson-Crick and Hoogsteen faces of a complementary guanine within a duplex, see for example Lin and Matteucci, 1998, *J. Am. Chem. Soc.*, 120, 8531-8532. A single G-clamp analog substitution within an oligonucleotide can result in substantially enhanced helical thermal stability and mismatch discrimination when hybridized to complementary oligonucleotides. The inclusion of such nucleotides in nucleic acid molecules of the invention results in both enhanced affinity and specificity to nucleic acid targets, complementary sequences, or template strands. In another embodiment, nucleic acid molecules of the invention include one or more (e.g., about 1, 2, 3, 4, 5, 6, 7, 8, 9, 10, or more) LNA "locked nucleic acid" nucleotides such as a 2',4'-C methylene bicyclo nucleotide (see for example Wengel et al., International PCT Publication No. WO 00/66604 and WO 99/14226).

In another embodiment, the invention features conjugates and/or complexes of siNA molecules of the invention. Such conjugates and/or complexes can be used to facilitate delivery of siNA molecules into a biological system, such as a cell. The conjugates and complexes provided by the instant invention can impart therapeutic activity by transferring therapeutic compounds across cellular membranes, altering the pharmacokinetics, and/or modulating the localization of nucleic acid molecules of the invention. The present invention encompasses the design and synthesis of novel conjugates and complexes for the delivery of molecules, including, but not limited to, small molecules, lipids, cholesterol, phospholipids, nucleosides, nucleotides, nucleic acids, antibodies, toxins, negatively charged polymers and other polymers, for example proteins, peptides, hormones, carbohydrates, polyethylene glycols, or polyamines, across cellular membranes. In general, the transporters described are designed to be used either individually or as part of a multi-component system, with or without degradable linkers. These compounds are expected to improve delivery and/or localization of nucleic acid molecules of the invention into a number of cell types originating from different tissues, in the presence or absence of serum (see Sullenger and Cech, U.S. Pat. No. 5,854,038). Conjugates of the molecules described herein can be attached to biologically active molecules via linkers that are biodegradable, such as biodegradable nucleic acid linker molecules.

The term "biodegradable linker" as used herein, refers to a nucleic acid or non-nucleic acid linker molecule that is designed as a biodegradable linker to connect one molecule to another molecule, for example, a biologically active molecule to a siNA molecule of the invention or the sense and antisense strands of a siNA molecule of the invention. The biodegradable linker is designed such that its stability can be modulated for a particular purpose, such as delivery to a particular tissue or cell type. The stability of a nucleic acid-based biodegradable linker molecule can be modulated by using various chemistries, for example combinations of ribonucleotides, deoxyribonucleotides, and chemically-modified nucleotides, such as 2'-O-methyl, 2'-fluoro, 2'-amino, 2'-O-amino, 2'-C-allyl, 2'-O-allyl, and other 2'-modified or base modified nucleotides. The biodegradable nucleic acid linker molecule can be a dimer, trimer, tetramer or longer nucleic acid molecule, for example, an oligonucleotide of about 2, 3, 4, 5, 6, 7, 8, 9, 10, 11, 12, 13, 14, 15, 16, 17, 18, 19, or 20 nucleotides in length, or can comprise a single nucleotide with a phosphorus-based linkage, for example, a phosphoramidate or phosphodiester linkage. The biodegradable nucleic acid linker molecule can also comprise nucleic acid backbone, nucleic acid sugar, or nucleic acid base modifications.

The term "biodegradable" as used herein, refers to degradation in a biological system, for example, enzymatic degradation or chemical degradation.

The term "biologically active molecule" as used herein refers to compounds or molecules that are capable of eliciting or modifying a biological response in a system. Non-limiting examples of biologically active siNA molecules either alone or in combination with other molecules contemplated by the instant invention include therapeutically active molecules such as antibodies, cholesterol, hormones, antivirals, peptides, proteins, chemotherapeutics, small molecules, vitamins, co-factors, nucleosides, nucleotides, oligonucleotides, enzymatic nucleic acids, antisense nucleic acids, triplex forming oligonucleotides, 2,5-A chimeras, siNA, dsRNA, allozymes, aptamers, decoys and analogs thereof. Biologically active molecules of the invention also include molecules capable of modulating the pharmacokinetics and/or pharmacodynamics of other biologically active molecules, for example, lipids and polymers such as polyamines, polyamides, polyethylene glycol and other polyethers.

The term "phospholipid" as used herein, refers to a hydrophobic molecule comprising at least one phosphorus group. For example, a phospholipid can comprise a phosphorus-containing group and saturated or unsaturated alkyl group, optionally substituted with OH, COOH, oxo, amine, or substituted or unsubstituted aryl groups.

Therapeutic nucleic acid molecules (e.g., siNA molecules) delivered exogenously optimally are stable within cells until reverse transcription of the RNA has been modulated long enough to reduce the levels of the RNA transcript. The nucleic acid molecules are resistant to nucleases in order to function as effective intracellular therapeutic agents. Improvements in the chemical synthesis of nucleic acid molecules described in the instant invention and in the art have expanded the ability to modify nucleic acid molecules by introducing nucleotide modifications to enhance their nuclease stability as described above.

In yet another embodiment, siNA molecules having chemical modifications that maintain or enhance enzymatic activity of proteins involved in RNAi are provided. Such nucleic acids are also generally more resistant to nucleases than unmodified nucleic acids. Thus, in vitro and/or in vivo the activity should not be significantly lowered.

Use of the nucleic acid-based molecules of the invention will lead to better treatments by affording the possibility of combination therapies (e.g., multiple siNA molecules targeted to different genes; nucleic acid molecules coupled with known small molecule modulators; or intermittent treatment with combinations of molecules, including different motifs and/or other chemical or biological molecules). The treatment of subjects with siNA molecules can also include combinations of different types of nucleic acid molecules, such as enzymatic nucleic acid molecules (ribozymes), allozymes, antisense, 2,5-A oligoadenylate, decoys, and aptamers.

In another aspect a siNA molecule of the invention comprises one or more 5' and/or a 3'-cap structure, for example, on only the sense siNA strand, the antisense siNA strand, or both siNA strands.

By "cap structure" is meant chemical modifications, which have been incorporated at either terminus of the oligonucleotide (see, for example, Adamic et al., U.S. Pat. No. 5,998, 203, incorporated by reference herein). These terminal modifications protect the nucleic acid molecule from exonuclease degradation, and may help in delivery and/or localization within a cell. The cap may be present at the 5'-terminus (5'-cap) or at the 3'-terminal (3'-cap) or may be present on both termini. In non-limiting examples, the 5'-cap includes, but is not limited to, glyceryl, inverted deoxy abasic residue (moiety); 4',5'-methylene nucleotide; 1-(beta-D-erythrofuranosyl) nucleotide, 4'-thio nucleotide; carbocyclic nucleotide; 1,5-anhydrohexitol nucleotide; L-nucleotides; alpha-nucleotides; modified base nucleotide; phosphorodithioate linkage; threo-pentofuranosyl nucleotide; acyclic 3',4'-seco nucleotide; acyclic 3,4-dihydroxybutyl nucleotide; acyclic 3,5-dihydroxypentyl nucleotide, 3'-3'-inverted nucleotide moiety; 3'-3'-inverted abasic moiety; 3'-2'-inverted nucleotide moiety; 3'-2'-inverted abasic moiety; 1,4-butanediol phosphate; 3'-phosphoramidate; hexylphosphate; aminohexyl phosphate; 3'-phosphate; 3'-phosphorothioate; phosphorodithioate; or bridging or non-bridging methylphosphonate moiety. Non-limiting examples of cap moieties are shown in FIG. 10.

Non-limiting examples of the 3'-cap include, but are not limited to, glyceryl, inverted deoxy abasic residue (moiety), 4',5'-methylene nucleotide; 1-(beta-D-erythrofuranosyl) nucleotide; 4'-thio nucleotide, carbocyclic nucleotide; 5'-amino-alkyl phosphate; 1,3-diamino-2-propyl phosphate; 3-aminopropyl phosphate; 6-aminohexyl phosphate; 1,2-aminododecyl phosphate; hydroxypropyl phosphate; 1,5-anhydrohexitol nucleotide; L-nucleotide; alpha-nucleotide; modified base nucleotide; phosphorodithioate; threo-pentofuranosyl nucleotide; acyclic 3',4'-seco nucleotide; 3,4-dihydroxybutyl nucleotide; 3,5-dihydroxypentyl nucleotide, 5'-5'-inverted nucleotide moiety; 5'-5'-inverted abasic moiety; 5'-phosphoramidate; 5'-phosphorothioate; 1,4-butanediol phosphate; 5'-amino; bridging and/or non-bridging 5'-phosphoramidate, phosphorothioate and/or phosphorodithioate, bridging or non bridging methylphosphonate and 5'-mercapto moieties (for more details see Beaucage and Iyer, 1993, *Tetrahedron* 49, 1925; incorporated by reference herein).

By the term "non-nucleotide" is meant any group or compound which can be incorporated into a nucleic acid chain in the place of one or more nucleotide units, including either sugar and/or phosphate substitutions, and allows the remaining bases to exhibit their enzymatic activity. The group or compound is abasic in that it does not contain a commonly recognized nucleotide base, such as adenosine, guanine, cytosine, uracil or thymine and therefore lacks a base at the 1'-position.

An "alkyl" group refers to a saturated aliphatic hydrocarbon, including straight-chain, branched-chain, and cyclic alkyl groups. Preferably, the alkyl group has 1 to 12 carbons. More preferably, it is a lower alkyl of from 1 to 7 carbons, more preferably 1 to 4 carbons. The alkyl group can be substituted or unsubstituted. When substituted the substituted group(s) is preferably, hydroxyl, cyano, alkoxy, =O, =S, $NO_2$ or $N(CH_3)_2$, amino, or SH. The term also includes alkenyl groups that are unsaturated hydrocarbon groups containing at least one carbon-carbon double bond, including straight-chain, branched-chain, and cyclic groups. Preferably, the alkenyl group has 1 to 12 carbons. More preferably, it is a lower alkenyl of from 1 to 7 carbons, more preferably 1 to 4 carbons. The alkenyl group may be substituted or unsubstituted. When substituted the substituted group(s) is preferably, hydroxyl, cyano, alkoxy, =O, =S, $NO_2$, halogen, $N(CH_3)_2$, amino, or SH. The term "alkyl" also includes alkynyl groups that have an unsaturated hydrocarbon group containing at least one carbon-carbon triple bond, including straight-chain, branched-chain, and cyclic groups. Preferably, the alkynyl group has 1 to 12 carbons. More preferably, it is a lower alkynyl of from 1 to 7 carbons, more preferably 1 to 4 carbons. The alkynyl group may be substituted or unsubstituted. When substituted the substituted group(s) is preferably, hydroxyl, cyano, alkoxy, =O, =S, $NO_2$ or $N(CH_3)_2$, amino or SH.

Such alkyl groups can also include aryl, alkylaryl, carbocyclic aryl, heterocyclic aryl, amide and ester groups. An "aryl" group refers to an aromatic group that has at least one ring having a conjugated pi electron system and includes carbocyclic aryl, heterocyclic aryl and biaryl groups, all of which may be optionally substituted. The preferred substituent(s) of aryl groups are halogen, trihalomethyl, hydroxyl, SH, OH, cyano, alkoxy, alkyl, alkenyl, alkynyl, and amino groups. An "alkylaryl" group refers to an alkyl group (as described above) covalently joined to an aryl group (as described above). Carbocyclic aryl groups are groups wherein the ring atoms on the aromatic ring are all carbon atoms. The carbon atoms are optionally substituted. Heterocyclic aryl groups are groups having from 1 to 3 heteroatoms as ring atoms in the aromatic ring and the remainder of the ring atoms are carbon atoms. Suitable heteroatoms include oxygen, sulfur, and nitrogen, and include furanyl, thienyl, pyridyl, pyrrolyl, N-lower alkyl pyrrolo, pyrimidyl, pyrazinyl, imidazolyl and the like, all optionally substituted. An "amide" refers to an —C(O)—NH—R, where R is either alkyl, aryl, alkylaryl or hydrogen. An "ester" refers to an —C(O)—OR', where R is either alkyl, aryl, alkylaryl or hydrogen.

By "nucleotide" as used herein is as recognized in the art to include natural bases (standard), and modified bases well known in the art. Such bases are generally located at the 1 position of a nucleotide sugar moiety. Nucleotides generally comprise a base, sugar and a phosphate group. The nucleotides can be unmodified or modified at the sugar, phosphate and/or base moiety, (also referred to interchangeably as nucleotide analogs, modified nucleotides, non-natural nucleotides, non-standard nucleotides and other; see, for example, Usman and McSwiggen, supra; Eckstein et al., International PCT Publication No. WO 92/07065; Usman et al., International PCT Publication No. WO 93/15187; Uhlman & Peyman, supra, all are hereby incorporated by reference herein). There are several examples of modified nucleic acid bases known in the art as summarized by Limbach et al., 1994, Nucleic Acids Res. 22, 2183. Some of the non-limiting examples of base modifications that can be introduced into nucleic acid molecules include, inosine, purine, pyridin-4-one, pyridin-2-one, phenyl, pseudouracil, 2,4,6-trimethoxy benzene, 3-methyl uracil, dihydrouridine, naphthyl, aminophenyl, 5-alkylcytidines (e.g., 5-methylcytidine), 5-alkyluridines (e.g., ribothymidine), 5-halouridine (e.g., 5-bromouridine) or 6-azapyrimidines or 6-alkylpyrimidines (e.g. 6-methyluridine), propyne, and others (Burgin et al., 1996, *Biochemistry*, 35, 14090; Uhlman & Peyman, supra). By "modified bases" in this aspect is meant nucleotide bases other than adenine, guanine, cytosine and uracil at 1' position or their equivalents.

In one embodiment, the invention features modified siNA molecules, with phosphate backbone modifications comprising one or more phosphorothioate, phosphorodithioate, methylphosphonate, phosphotriester, morpholino, amidate carbamate, carboxymethyl, acetamidate, polyamide, sulfonate, sulfonamide, sulfamate, formacetal, thioformacetal, and/or alkylsilyl, substitutions. For a review of oligonucleotide backbone modifications, see Hunziker and Leumann, 1995, *Nucleic Acid Analogues: Synthesis and Properties*, in *Modern Synthetic Methods*, VCH, 331-417, and Mesmaeker et al., 1994, *Novel Backbone Replacements for Oligonucleotides, in Carbohydrate Modifications in Antisense Research*, ACS, 24-39.

By "abasic" is meant sugar moieties lacking a nucleobase or having a hydrogen atom (H) or other non-nucleobase chemical groups in place of a nucleobase at the 1 position of the sugar moiety, see for example Adamic et al., U.S. Pat. No. 5,998,203. In one embodiment, an abasic moiety of the invention is a ribose, deoxyribose, or dideoxyribose sugar.

By "unmodified nucleoside" is meant one of the bases adenine, cytosine, guanine, thymine, or uracil joined to the 1 carbon of β-D-ribo-furanose.

By "modified nucleoside" is meant any nucleotide base which contains a modification in the chemical structure of an unmodified nucleotide base, sugar and/or phosphate. Non-limiting examples of modified nucleotides are shown by Formulae I-VII and/or other modifications described herein.

In connection with 2'-modified nucleotides as described for the present invention, by "amino" is meant 2'-NH$_2$ or 2'-O—NH$_2$, which can be modified or unmodified. Such modified groups are described, for example, in Eckstein et al., U.S. Pat. No. 5,672,695 and Matulic-Adamic et al., U.S. Pat. No. 6,248,878, which are both incorporated by reference in their entireties.

Various modifications to nucleic acid siNA structure can be made to enhance the utility of these molecules. Such modifications will enhance shelf-life, half-life in vitro, stability, and ease of introduction of such oligonucleotides to the target site, e.g., to enhance penetration of cellular membranes, and confer the ability to recognize and bind to targeted cells.

Administration of Nucleic Acid Molecules

A siNA molecule of the invention can be adapted for use to treat, prevent, inhibit, or reduce RSV infection, respiratory distress, bronchiolitis and pneumonia and/or any other trait, disease or condition that is related to or will respond to the levels of RSV in a cell or tissue, alone or in combination with other therapies. In one embodiment, the siNA molecules of the invention and formulations or compositions thereof are administered to the lung as is described herein and as is generally known in the art.

In one embodiment, a siNA composition of the invention can comprise a delivery vehicle, including liposomes, for administration to a subject, carriers and diluents and their salts, and/or can be present in pharmaceutically acceptable formulations. Methods for the delivery of nucleic acid molecules are described in Akhtar et al., 1992, *Trends Cell Bio.*, 2, 139; *Delivery Strategies for Antisense Oligonucleotide Therapeutics*, ed. Akhtar, 1995, Maurer et al., 1999, *Mol. Membr. Biol.*, 16, 129-140; Hofland and Huang, 1999, *Handb. Exp. Pharmacol.*, 137, 165-192; and Lee et al., 2000, *ACS Symp. Ser.*, 752, 184-192, all of which are incorporated herein by reference. Beigelman et al., U.S. Pat. No. 6,395,713 and Sullivan et al., PCT WO 94/02595 further describe the general methods for delivery of nucleic acid molecules. These protocols can be utilized for the delivery of virtually any nucleic acid molecule. Nucleic acid molecules can be administered to cells by a variety of methods known to those of skill in the art, including, but not restricted to, encapsulation in liposomes, by iontophoresis, or by incorporation into other vehicles, such as biodegradable polymers, hydrogels, cyclodextrins (see for example Gonzalez et al., 1999, *Bioconjugate Chem.*, 10, 1068-1074; Wang et al., International PCT publication Nos. WO 03/47518 and WO 03/46185), poly(lactic-co-glycolic) acid (PLGA) and PLCA microspheres (see for example U.S. Pat. No. 6,447,796 and US Patent Application Publication No. US 2002130430), biodegradable nanocapsules, and bioadhesive microspheres, or by proteinaceous vectors (O'Hare and Normand, International PCT Publication No. WO 00/53722). In another embodiment, the nucleic acid molecules of the invention can also be formulated or complexed with polyethyleneimine and derivatives thereof, such as polyethyleneimine-polyethyleneglycol-N-acetylgalactosamine (PEI-PEG-GAL) or polyethyleneimine-polyethyleneglycol-tri-N-acetylgalactosamine (PEI-PEG-triGAL) derivatives. In one embodiment, the nucleic acid molecules of the invention are formulated as described in United States Patent Application Publication No. 20030077829, incorporated by reference herein in its entirety.

In one embodiment, a siNA molecule of the invention is formulated as a composition described in U.S. Provisional patent application No. 60/678,531 and in related U.S. Provisional patent application No. 60/703,946, filed Jul. 29, 2005, U.S. Provisional patent application No. 60/737,024, filed Nov. 15, 2005, and U.S. Ser. No. 11/353,630, filed Feb. 14, 2006 (Vargeese et al.), all of which are incorporated by reference herein in their entirety. Such siNA formulations are generally referred to as "lipid nucleic acid particles" (LNP). In one embodiment, a siNA molecule of the invention is formulated with one or more LNP compositions described herein in Table IV (see U.S. Ser. No. 11/353,630 supra).

In one embodiment, the siNA molecules of the invention and formulations or compositions thereof are administered to lung tissues and cells as is described in US 2006/0062758; US 2006/0014289; and US 2004/0077540.

In one embodiment, a siNA molecule of the invention is complexed with membrane disruptive agents such as those described in U.S. Patent Application Publication No. 20010007666, incorporated by reference herein in its entirety including the drawings. In another embodiment, the membrane disruptive agent or agents and the siNA molecule are also complexed with a cationic lipid or helper lipid molecule, such as those lipids described in U.S. Pat. No. 6,235,310, incorporated by reference herein in its entirety including the drawings.

In one embodiment, a siNA molecule of the invention is complexed with delivery systems as described in U.S. Patent Application Publication No. 2003077829 and International PCT Publication Nos. WO 00/03683 and WO 02/087541, all incorporated by reference herein in their entirety including the drawings.

In one embodiment, the nucleic acid molecules of the invention and formulations thereof (e.g., LNP formulations of double stranded nucleic acid molecules of the invention) are administered via pulmonary delivery, such as by inhalation of an aerosol or spray dried formulation administered by an inhalation device or nebulizer, providing rapid local uptake of the nucleic acid molecules into relevant pulmonary tissues. Solid particulate compositions containing respirable dry particles of micronized nucleic acid compositions can be prepared by grinding dried or lyophilized nucleic acid compositions, and then passing the micronized composition through, for example, a 400 mesh screen to break up or separate out large agglomerates. A solid particulate composition comprising the nucleic acid compositions of the invention can optionally contain a dispersant which serves to facilitate the formation of an aerosol as well as other therapeutic compounds. A suitable dispersant is lactose, which can be blended with the nucleic acid compound in any suitable ratio, such as a 1 to 1 ratio by weight.

Aerosols of liquid particles comprising a nucleic acid composition of the invention can be produced by any suitable means, such as with a nebulizer (see for example U.S. Pat. No. 4,501,729). Nebulizers are commercially available devices which transform solutions or suspensions of an active ingredient into a therapeutic aerosol mist either by means of acceleration of a compressed gas, typically air or oxygen, through a narrow venturi orifice or by means of ultrasonic agitation. Suitable formulations for use in nebulizers comprise the active ingredient in a liquid carrier in an amount of up to 40% w/w preferably less than 20% w/w of the formulation. The carrier is typically water or a dilute aqueous alcoholic solution, preferably made isotonic with body fluids by the addition of, for example, sodium chloride or other suitable salts. Optional additives include preservatives if the formulation is not prepared sterile, for example, methyl hydroxybenzoate, anti-oxidants, flavorings, volatile oils, buffering agents and emulsifiers and other formulation surfactants. The aerosols of solid particles comprising the active composition and surfactant can likewise be produced with any solid particulate aerosol generator. Aerosol generators for administering solid particulate therapeutics to a subject produce particles which are respirable, as explained above, and generate a volume of aerosol containing a predetermined metered dose of a therapeutic composition at a rate suitable for human administration.

In one embodiment, a solid particulate aerosol generator of the invention is an insufflator. Suitable formulations for administration by insufflation include finely comminuted powders which can be delivered by means of an insufflator. In the insufflator, the powder, e.g., a metered dose thereof effective to carry out the treatments described herein, is contained in capsules or cartridges, typically made of gelatin or plastic, which are either pierced or opened in situ and the powder delivered by air drawn through the device upon inhalation or by means of a manually-operated pump. The powder employed in the insufflator consists either solely of the active ingredient or of a powder blend comprising the active ingredient, a suitable powder diluent, such as lactose, and an optional surfactant. The active ingredient typically comprises from 0.1 to 100 w/w of the formulation. A second type of illustrative aerosol generator comprises a metered dose inhaler. Metered dose inhalers are pressurized aerosol dispensers, typically containing a suspension or solution formulation of the active ingredient in a liquified propellant. During use these devices discharge the formulation through a valve adapted to deliver a metered volume to produce a fine particle spray containing the active ingredient. Suitable propellants include certain chlorofluorocarbon compounds, for example, dichlorodifluoromethane, trichlorofluoromethane, dichlorotetrafluoroethane and mixtures thereof. The formulation can additionally contain one or more co-solvents, for example, ethanol, emulsifiers and other formulation surfactants, such as oleic acid or sorbitan trioleate, anti-oxidants and suitable flavoring agents. Other methods for pulmonary delivery are described in, for example US Patent Application No. 20040037780, and U.S. Pat. Nos. 6,592,904; 6,582,728; 6,565,885, all incorporated by reference herein.

In one embodiment, the siNA and LNP compositions and formulations provided herein for use in pulmonary delivery further comprise one or more surfactants. Suitable surfactants or surfactant components for enhancing the uptake of the compositions of the invention include synthetic and natural as well as full and truncated forms of surfactant protein A, surfactant protein B, surfactant protein C, surfactant protein D and surfactant Protein E, di-saturated phosphatidylcholine (other than dipalmitoyl), dipalmitoylphosphatidylcholine, phosphatidylcholine, phosphatidylglycerol, phosphatidylinositol, phosphatidylethanolamine, phosphatidylserine; phosphatidic acid, ubiquinones, lysophosphatidylethanolamine, lysophosphatidylcholine, palmitoyl-lysophosphatidylcholine, dehydroepiandrosterone, dolichols, sulfatidic acid, glycerol-3-phosphate, dihydroxyacetone phosphate, glycerol, glycero-3-phosphocholine, dihydroxyacetone, palmitate, cytidine diphosphate (CDP) diacylglycerol, CDP choline, choline, choline phosphate; as well as natural and artificial lamelar bodies which are the natural carrier vehicles for the components of surfactant, omega-3 fatty acids, polyenic acid, polyenoic acid, lecithin, palmitinic acid, non-ionic block copolymers of ethylene or propylene oxides, polyoxypropylene, monomeric and polymeric, polyoxyethylene, monomeric and polymeric, poly (vinyl amine) with dextran and/or alkanoyl side chains, Brij 35, Triton X-100 and synthetic surfactants ALEC, Exosurf, Survan and Atovaquone, among others. These surfactants may be used either as single or part of a multiple component surfactant in a formulation, or as covalently bound additions to the 5' and/or 3' ends of the nucleic acid component of a pharmaceutical composition herein.

The composition of the present invention may be administered into the respiratory system as a formulation including particles of respirable size, e.g. particles of a size sufficiently small to pass through the nose, mouth and larynx upon inhalation and through the bronchi and alveoli of the lungs. In general, respirable particles range from about 0.5 to 10 microns in size. Particles of non-respirable size which are included in the aerosol tend to deposit in the throat and be swallowed, and the quantity of non-respirable particles in the aerosol is thus minimized. For nasal administration, a particle size in the range of 10-500 um is preferred to ensure retention in the nasal cavity.

In one embodiment, the invention features the use of methods to deliver the nucleic acid molecules of the instant invention to the central nervous system and/or peripheral nervous system. Experiments have demonstrated the efficient in vivo uptake of nucleic acids by neurons. As an example of local administration of nucleic acids to nerve cells, Sommer et al., 1998, *Antisense Nuc. Acid Drug Dev.,* 8, 75, describe a study in which a 15mer phosphorothioate antisense nucleic acid molecule to c-fos is administered to rats via microinjection into the brain. Antisense molecules labeled with tetramethylrhodamine-isothiocyanate (TRITC) or fluorescein isothiocyanate (FITC) were taken up by exclusively by neurons thirty minutes post-injection. A diffuse cytoplasmic staining and nuclear staining was observed in these cells. As an example of systemic administration of nucleic acid to nerve cells, Epa et al., 2000, *Antisense Nuc. Acid Drug Dev.,* 10, 469, describe an in vivo mouse study in which beta-cyclodextrin-adamantane-oligonucleotide conjugates were used to target the p75 neurotrophin receptor in neuronally differentiated PC12 cells. Following a two week course of IP administration, pronounced uptake of p75 neurotrophin receptor antisense was observed in dorsal root ganglion (DRG) cells. In addition, a marked and consistent down-regulation of p75 was observed in DRG neurons. Additional approaches to the targeting of nucleic acid to neurons are described in Broaddus et al., 1998, *J. Neurosurg.,* 88(4), 734; Karle et al., 1997, *Eur. J. Pharmocol.,* 340(2/3), 153; Bannai et al., 1998, *Brain Research,* 784 (1,2), 304; Rajakumar et al., 1997, *Synapse,* 26(3), 199; Wupong et al., 1999, *BioPharm,* 12(1), 32; Bannai et al., 1998, *Brain Res. Protoc.,* 3(1), 83; Simantov et al., 1996, *Neuroscience,* 74(1), 39. Nucleic acid molecules of the invention are therefore amenable to delivery to and uptake by cells that express repeat expansion allelic variants for modulation of RE gene expression. The delivery of nucleic acid molecules of the invention, targeting RE is provided by a variety of different strategies. Traditional approaches to CNS delivery that can be used include, but are not limited to, intrathecal and intracerebroventricular administration, implantation of catheters and pumps, direct injection or perfusion at the site of injury or lesion, injection into the brain arterial system, or by chemical or osmotic opening of the blood-brain barrier. Other approaches can include the use of various transport and carrier systems, for example though the use of conjugates and biodegradable polymers. Furthermore, gene therapy approaches, for example as described in Kaplitt et al., U.S. Pat. No. 6,180,613 and Davidson, WO 04/013280, can be used to express nucleic acid molecules in the CNS.

The delivery of nucleic acid molecules of the invention to the CNS is provided by a variety of different strategies. Traditional approaches to CNS delivery that can be used include, but are not limited to, intrathecal and intracerebroventricular administration, implantation of catheters and pumps, direct injection or perfusion at the site of injury or lesion, injection into the brain arterial system, or by chemical or osmotic opening of the blood-brain barrier. Other approaches can include the use of various transport and carrier systems, for example though the use of conjugates and biodegradable polymers. Furthermore, gene therapy approaches, for example as described in Kaplitt et al., U.S. Pat. No. 6,180,613 and Davidson, WO 04/013280, can be used to express nucleic acid molecules in the CNS.

In one embodiment, siNA compounds and compositions of the invention are administered either systemically or locally about every 1-50 weeks (e.g., about every 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 weeks), alone or in combination with other compounds and/or therapeis herein. In one embodiment, siNA compounds and compositions of the invention are administered systemically (e.g., via intravenous, subcutaneous, intramuscular, infusion, pump, implant etc.) about every 1-50 weeks (e.g., about every 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 weeks), alone or in combination with other compounds and/or therapies described herein and/or otherwise known in the art.

In one embodiment, a siNA molecule of the invention is administered iontophoretically, for example to a particular organ or compartment (e.g., lung, liver, CNS etc.). Non-limiting examples of iontophoretic delivery are described in, for example, WO 03/043689 and WO 03/030989, which are incorporated by reference in their entireties herein.

In one embodiment, the invention features the use of methods to deliver the nucleic acid molecules of the instant invention to hematopoietic cells, including monocytes and lymphocytes. These methods are described in detail by Hartmann et al., 1998, *J. Phamacol. Exp. Ther.*, 285(2), 920-928; Kronenwett et al., 1998, *Blood*, 91(3), 852-862; Filion and Phillips, 1997, *Biochim. Biophys. Acta.*, 1329(2), 345-356; Ma and Wei, 1996, *Leuk. Res.*, 20(11/12), 925-930; and Bongartz et al., 1994, *Nucleic Acids Research*, 22(22), 4681-8. Such methods, as described above, include the use of free oligonucleotide, cationic lipid formulations, liposome formulations including pH sensitive liposomes and immunoliposomes, and bioconjugates including oligonucleotides conjugated to fusogenic peptides, for the transfection of hematopoietic cells with oligonucleotides. In certain embodiment, the nucleic acid molecules of the invention are delivered to hematopoetic cells as is described in U.S. Provisional patent application No. 60/678,531 and in related U.S. Provisional patent application No. 60/703,946, filed Jul. 29, 2005, and U.S. Provisional patent application No. 60/737,024, filed Nov. 15, 2005, and U.S. Ser. No. 11/353,630, filed Feb. 14, 2006 (Vargeese et al.), all of which are incorporated by reference herein in their entirety.

In one embodiment, delivery systems of the invention include, for example, aqueous and nonaqueous gels, creams, multiple emulsions, microemulsions, liposomes, ointments, aqueous and nonaqueous solutions, lotions, aerosols, hydrocarbon bases and powders, and can contain excipients such as solubilizers, permeation enhancers (e.g., fatty acids, fatty acid esters, fatty alcohols and amino acids), and hydrophilic polymers (e.g., polycarbophil and polyvinylpyrolidone). In one embodiment, the pharmaceutically acceptable carrier is a liposome or a transdermal enhancer. Examples of liposomes which can be used in this invention include the following: (1) CellFectin, 1:1.5 (M/M) liposome formulation of the cationic lipid N,NI,NII,NIII-tetramethyl-N,NI,NII,NIII-tetrapalmit-y-spermine and dioleoyl phosphatidylethanolamine (DOPE) (GIBCO BRL); (2) Cytofectin GSV, 2:1 (M/M) liposome formulation of a cationic lipid and DOPE (Glen Research); (3) DOTAP (N-[1-(2,3-dioleoyloxy)-N,N,N-tri-methyl-ammoniummethylsulfate) (Boehringer Manheim); and (4) Lipofectamine, 3:1 (M/M) liposome formulation of the polycationic lipid DOSPA and the neutral lipid DOPE (GIBCO BRL).

In one embodiment, delivery systems of the invention include patches, tablets, suppositories, pessaries, gels and creams, and can contain excipients such as solubilizers and enhancers (e.g., propylene glycol, bile salts and amino acids), and other vehicles (e.g., polyethylene glycol, fatty acid esters and derivatives, and hydrophilic polymers such as hydroxypropylmethylcellulose and hyaluronic acid).

In one embodiment, siNA molecules of the invention are formulated or complexed with polyethylenimine (e.g., linear or branched PEI) and/or polyethylenimine derivatives, including for example grafted PEIs such as galactose PEI, cholesterol PEI, antibody derivatized PEI, and polyethylene glycol PEI (PEG-PEI) derivatives thereof (see for example Ogris et al., 2001, *AAPA PharmSci*, 3, 1-11; Furgeson et al., 2003, Bioconjugate Chem., 14, 840-847; Kunath et al., 2002, Phramaceutical Research, 19, 810-817; Choi et al., 2001, Bull. Korean Chem. Soc., 22, 46-52; Bettinger et al., 1999, Bioconjugate Chem., 10, 558-561; Peterson et al., 2002, Bioconjugate Chem., 13, 845-854; Erbacher et al., 1999, Journal of Gene Medicine Preprint, 1, 1-18; Godbey et al., 1999., PNAS USA, 96, 5177-5181; Godbey et al., 1999, Journal of Controlled Release, 60, 149-160; Diebold et al., 1999, Journal of Biological Chemistry, 274, 19087-19094; Thomas and Klibanov, 2002, PNAS USA, 99, 14640-14645; and Sagara, U.S. Pat. No. 6,586,524, incorporated by reference herein.

In one embodiment, a siNA molecule of the invention comprises a bioconjugate, for example a nucleic acid conjugate as described in Vargeese et al., U.S. Ser. No. 10/427,160, filed Apr. 30, 2003; U.S. Pat. Nos. 6,528,631; 6,335,434; 6,235,886; 6,153,737; 5,214,136; 5,138,045, all incorporated by reference herein.

Thus, the invention features a pharmaceutical composition comprising one or more nucleic acid(s) of the invention in an acceptable carrier, such as a stabilizer, buffer, and the like. The polynucleotides of the invention can be administered (e.g., RNA, DNA or protein) and introduced to a subject by any standard means, with or without stabilizers, buffers, and the like, to form a pharmaceutical composition. When it is desired to use a liposome delivery mechanism, standard protocols for formation of liposomes can be followed. The compositions of the present invention can also be formulated and used as creams, gels, sprays, oils and other suitable compositions for topical, dermal, or transdermal administration as is known in the art.

The present invention also includes pharmaceutically acceptable formulations of the compounds described. These formulations include salts of the above compounds, e.g., acid addition salts, for example, salts of hydrochloric, hydrobromic, acetic acid, and benzene sulfonic acid.

A pharmacological composition or formulation refers to a composition or formulation in a form suitable for administration, e.g., systemic or local administration, into a cell or subject, including for example a human. Suitable forms, in part, depend upon the use or the route of entry, for example oral, transdermal, or by injection. Such forms should not prevent the composition or formulation from reaching a target cell (i.e., a cell to which the negatively charged nucleic acid is desirable for delivery). For example, pharmacological compositions injected into the blood stream should be soluble.

Other factors are known in the art, and include considerations such as toxicity and forms that prevent the composition or formulation from exerting its effect.

In one embodiment, siNA molecules of the invention are administered to a subject by systemic administration in a pharmaceutically acceptable composition or formulation. By "systemic administration" is meant in vivo systemic absorption or accumulation of drugs in the blood stream followed by distribution throughout the entire body. Administration routes that lead to systemic absorption include, without limitation: intravenous, subcutaneous, portal vein, intraperitoneal, inhalation, oral, intrapulmonary and intramuscular. Each of these administration routes exposes the siNA molecules of the invention to an accessible diseased tissue (e.g., lung). The rate of entry of a drug into the circulation has been shown to be a function of molecular weight or size. The use of a liposome or other drug carrier comprising the compounds of the instant invention can potentially localize the drug, for example, in certain tissue types, such as the tissues of the reticular endothelial system (RES). A liposome formulation that can facilitate the association of drug with the surface of cells, such as, lymphocytes and macrophages is also useful. This approach can provide enhanced delivery of the drug to target cells by taking advantage of the specificity of macrophage and lymphocyte immune recognition of abnormal cells.

By "pharmaceutically acceptable formulation" or "pharmaceutically acceptable composition" is meant, a composition or formulation that allows for the effective distribution of the nucleic acid molecules of the instant invention in the physical location most suitable for their desired activity. Non-limiting examples of agents suitable for formulation with the nucleic acid molecules of the instant invention include: P-glycoprotein inhibitors (such as Pluronic P85); biodegradable polymers, such as poly (DL-lactide-coglycolide) microspheres for sustained release delivery (Emerich, D F et al, 1999, *Cell Transplant*, 8, 47-58); and loaded nanoparticles, such as those made of polybutylcyanoacrylate. Other non-limiting examples of delivery strategies for the nucleic acid molecules of the instant invention include material described in Boado et al., 1998, *J. Pharm. Sci.*, 87, 1308-1315; Tyler et al., 1999, *FEBS Lett.*, 421, 280-284; Pardridge et al., 1995, *PNAS USA.*, 92, 5592-5596; Boado, 1995, *Adv. Drug Delivery Rev.*, 15, 73-107; Aldrian-Herrada et al., 1998, *Nucleic Acids Res.*, 26, 4910-4916; and Tyler et al., 1999, *PNAS USA.*, 96, 7053-7058.

The invention also features the use of a composition comprising surface-modified liposomes containing poly (ethylene glycol) lipids (PEG-modified, or long-circulating liposomes or stealth liposomes) and nucleic acid molecules of the invention. These formulations offer a method for increasing the accumulation of drugs (e.g., siNA) in target tissues. This class of drug carriers resists opsonization and elimination by the mononuclear phagocytic system (MPS or RES), thereby enabling longer blood circulation times and enhanced tissue exposure for the encapsulated drug (Lasic et al. *Chem. Rev.* 1995, 95, 2601-2627; Ishiwata et al., *Chem. Pharm. Bull.* 1995, 43, 1005-1011). Such liposomes have been shown to accumulate selectively in tumors, presumably by extravasation and capture in the neovascularized target tissues (Lasic et al., *Science* 1995, 267, 1275-1276; Oku et al., 1995, *Biochim. Biophys. Acta,* 1238, 86-90). The long-circulating liposomes enhance the pharmacokinetics and pharmacodynamics of DNA and RNA, particularly compared to conventional cationic liposomes which are known to accumulate in tissues of the MPS (Liu et al., *J. Biol. Chem.* 1995, 42, 24864-24870; Choi et al., International PCT Publication No. WO 96/10391; Ansell et al., International PCT Publication No. WO 96/10390; Holland et al., International PCT Publication No. WO 96/10392). Long-circulating liposomes are also likely to protect drugs from nuclease degradation to a greater extent compared to cationic liposomes, based on their ability to avoid accumulation in metabolically aggressive MPS tissues such as the liver and spleen.

In one embodiment, a liposomal formulation of the invention comprises a double stranded nucleic acid molecule of the invention (e.g, siNA) formulated or complexed with compounds and compositions described in U.S. Pat. Nos. 6,858,224; 6,534,484; 6,287,591; 6,835,395; 6,586,410; 6,858,225; 6,815,432; 6,586,001; 6,120,798; 6,977,223; 6,998,115; 5,981,501; 5,976,567; 5,705,385; US 2006/0019912; US 2006/0019258; US 2006/0008909; US 2005/0255153; US 2005/0079212; US 2005/0008689; US 2003/0077829, US 2005/0064595, US 2005/0175682, US 2005/0118253; US 2004/0071654; US 2005/0244504; US 2005/0265961 and US 2003/0077829, all of which are incorporated by reference herein in their entirety.

The present invention also includes compositions prepared for storage or administration that include a pharmaceutically effective amount of the desired compounds in a pharmaceutically acceptable carrier or diluent. Acceptable carriers or diluents for therapeutic use are well known in the pharmaceutical art, and are described, for example, in *Remington's Pharmaceutical Sciences*, Mack Publishing Co. (A. R. Gennaro edit. 1985), hereby incorporated by reference herein. For example, preservatives, stabilizers, dyes and flavoring agents can be provided. These include sodium benzoate, sorbic acid and esters of p-hydroxybenzoic acid. In addition, antioxidants and suspending agents can be used.

A pharmaceutically effective dose is that dose required to prevent, inhibit the occurrence, or treat (alleviate a symptom to some extent, preferably all of the symptoms) of a disease state. The pharmaceutically effective dose depends on the type of disease, the composition used, the route of administration, the type of mammal being treated, the physical characteristics of the specific mammal under consideration, concurrent medication, and other factors that those skilled in the medical arts will recognize. Generally, an amount between 0.1 mg/kg and 100 mg/kg body weight/day of active ingredients is administered dependent upon potency of the negatively charged polymer.

The nucleic acid molecules of the invention and formulations thereof can be administered orally, topically, parenterally, by inhalation or spray, or rectally in dosage unit formulations containing conventional non-toxic pharmaceutically acceptable carriers, adjuvants and/or vehicles. The term parenteral as used herein includes percutaneous, subcutaneous, intravascular (e.g., intravenous), intramuscular, or intrathecal injection or infusion techniques and the like. In addition, there is provided a pharmaceutical formulation comprising a nucleic acid molecule of the invention and a pharmaceutically acceptable carrier. One or more nucleic acid molecules of the invention can be present in association with one or more non-toxic pharmaceutically acceptable carriers and/or diluents and/or adjuvants, and if desired other active ingredients. The pharmaceutical compositions containing nucleic acid molecules of the invention can be in a form suitable for oral use, for example, as tablets, troches, lozenges, aqueous or oily suspensions, dispersible powders or granules, emulsion, hard or soft capsules, or syrups or elixirs.

Compositions intended for oral use can be prepared according to any method known to the art for the manufacture of pharmaceutical compositions and such compositions can contain one or more such sweetening agents, flavoring agents, coloring agents or preservative agents in order to provide pharmaceutically elegant and palatable preparations. Tablets contain the active ingredient in admixture with non-toxic pharmaceutically acceptable excipients that are suitable for the manufacture of tablets. These excipients can be, for example, inert diluents; such as calcium carbonate, sodium carbonate, lactose, calcium phosphate or sodium phosphate; granulating and disintegrating agents, for example, corn starch, or alginic acid; binding agents, for example starch, gelatin or acacia; and lubricating agents, for example magnesium stearate, stearic acid or talc. The tablets can be uncoated or they can be coated by known techniques. In some cases such coatings can be prepared by known techniques to delay disintegration and absorption in the gastrointestinal tract and thereby provide a sustained action over a longer period. For example, a time delay material such as glyceryl monosterate or glyceryl distearate can be employed.

Formulations for oral use can also be presented as hard gelatin capsules wherein the active ingredient is mixed with an inert solid diluent, for example, calcium carbonate, calcium phosphate or kaolin, or as soft gelatin capsules wherein the active ingredient is mixed with water or an oil medium, for example peanut oil, liquid paraffin or olive oil.

Aqueous suspensions contain the active materials in a mixture with excipients suitable for the manufacture of aqueous suspensions. Such excipients are suspending agents, for example sodium carboxymethylcellulose, methylcellulose, hydropropyl-methylcellulose, sodium alginate, polyvinylpyrrolidone, gum tragacanth and gum acacia; dispersing or wetting agents can be a naturally-occurring phosphatide, for example, lecithin, or condensation products of an alkylene oxide with fatty acids, for example polyoxyethylene stearate, or condensation products of ethylene oxide with long chain aliphatic alcohols, for example heptadecaethyleneoxycetanol, or condensation products of ethylene oxide with partial esters derived from fatty acids and a hexitol such as polyoxyethylene sorbitol monooleate, or condensation products of ethylene oxide with partial esters derived from fatty acids and hexitol anhydrides, for example polyethylene sorbitan monooleate. The aqueous suspensions can also contain one or more preservatives, for example ethyl, or n-propyl p-hydroxybenzoate, one or more coloring agents, one or more flavoring agents, and one or more sweetening agents, such as sucrose or saccharin.

Oily suspensions can be formulated by suspending the active ingredients in a vegetable oil, for example arachis oil, olive oil, sesame oil or coconut oil, or in a mineral oil such as liquid paraffin. The oily suspensions can contain a thickening agent, for example beeswax, hard paraffin or cetyl alcohol. Sweetening agents and flavoring agents can be added to provide palatable oral preparations. These compositions can be preserved by the addition of an anti-oxidant such as ascorbic acid Dispersible powders and granules suitable for preparation of an aqueous suspension by the addition of water provide the active ingredient in admixture with a dispersing or wetting agent, suspending agent and one or more preservatives. Suitable dispersing or wetting agents or suspending agents are exemplified by those already mentioned above. Additional excipients, for example sweetening, flavoring and coloring agents, can also be present.

Pharmaceutical compositions of the invention can also be in the form of oil-in-water emulsions. The oily phase can be a vegetable oil or a mineral oil or mixtures of these. Suitable emulsifying agents can be naturally-occurring gums, for example gum acacia or gum tragacanth, naturally-occurring phosphatides, for example soy bean, lecithin, and esters or partial esters derived from fatty acids and hexitol, anhydrides, for example sorbitan monooleate, and condensation products of the said partial esters with ethylene oxide, for example polyoxyethylene sorbitan monooleate. The emulsions can also contain sweetening and flavoring agents.

Syrups and elixirs can be formulated with sweetening agents, for example glycerol, propylene glycol, sorbitol, glucose or sucrose. Such formulations can also contain a demulcent, a preservative and flavoring and coloring agents. The pharmaceutical compositions can be in the form of a sterile injectable aqueous or oleaginous suspension. This suspension can be formulated according to the known art using those suitable dispersing or wetting agents and suspending agents that have been mentioned above. The sterile injectable preparation can also be a sterile injectable solution or suspension in a non-toxic parentally acceptable diluent or solvent, for example as a solution in 1,3-butanediol. Among the acceptable vehicles and solvents that can be employed are water, Ringer's solution and isotonic sodium chloride solution. In addition, sterile, fixed oils are conventionally employed as a solvent or suspending medium. For this purpose, any bland fixed oil can be employed including synthetic mono- or diglycerides. In addition, fatty acids such as oleic acid find use in the preparation of injectables.

The nucleic acid molecules of the invention can also be administered in the form of suppositories, e.g., for rectal administration of the drug. These compositions can be prepared by mixing the drug with a suitable non-irritating excipient that is solid at ordinary temperatures but liquid at the rectal temperature and will therefore melt in the rectum to release the drug. Such materials include cocoa butter and polyethylene glycols.

Nucleic acid molecules of the invention can be administered parenterally in a sterile medium. The drug, depending on the vehicle and concentration used, can either be suspended or dissolved in the vehicle. Advantageously, adjuvants such as local anesthetics, preservatives and buffering agents can be dissolved in the vehicle.

Dosage levels of the order of from about 0.1 mg to about 140 mg per kilogram of body weight per day are useful in the treatment of the above-indicated conditions (about 0.5 mg to about 7 g per subject per day). The amount of active ingredient that can be combined with the carrier materials to produce a single dosage form varies depending upon the host treated and the particular mode of administration. Dosage unit forms generally contain between from about 1 mg to about 500 mg of an active ingredient.

It is understood that the specific dose level for any particular subject depends upon a variety of factors including the activity of the specific compound employed, the age, body weight, general health, sex, diet, time of administration, route of administration, and rate of excretion, drug combination and the severity of the particular disease undergoing therapy.

For administration to non-human animals, the composition can also be added to the animal feed or drinking water. It can be convenient to formulate the animal feed and drinking water compositions so that the animal takes in a therapeutically appropriate quantity of the composition along with its diet. It can also be convenient to present the composition as a premix for addition to the feed or drinking water.

The nucleic acid molecules of the present invention can also be administered to a subject in combination with other therapeutic compounds to increase the overall therapeutic effect. The use of multiple compounds to treat an indication can increase the beneficial effects while reducing the presence of side effects.

In one embodiment, the invention comprises compositions suitable for administering nucleic acid molecules of the invention to specific cell types. For example, the asialoglycoprotein receptor (ASGPr) (Wu and Wu, 1987, *J. Biol. Chem.* 262, 4429-4432) is unique to hepatocytes and binds branched galactose-terminal glycoproteins, such as asialoorosomucoid (ASOR). In another example, the folate receptor is overexpressed in many cancer cells. Binding of such glycoproteins, synthetic glycoconjugates, or folates to the receptor takes place with an affinity that strongly depends on the degree of branching of the oligosaccharide chain, for example, triatennary structures are bound with greater affinity than biatenarry or monoatennary chains (Baenziger and Fiete, 1980, *Cell,* 22, 611-620; Connolly et al., 1982, *J. Biol. Chem.,* 257, 939-945). Lee and Lee, 1987, *Glycoconjugate J.,* 4, 317-328, obtained this high specificity through the use of N-acetyl-D-galactosamine as the carbohydrate moiety, which has higher affinity for the receptor, compared to galactose. This "clustering effect" has also been described for the binding and uptake of mannosyl-terminating glycoproteins or glycoconjugates (Ponpipom et al., 1981, *J. Med. Chem.,* 24, 1388-1395). The use of galactose, galactosamine, or folate based conjugates to transport exogenous compounds across cell membranes can provide a targeted delivery approach to, for example, the treatment of liver disease, cancers of the liver, or other cancers. The use of bioconjugates can also provide a reduction in the required dose of therapeutic compounds required for treatment. Furthermore, therapeutic bioavailability, pharmacodynamics, and pharmacokinetic parameters can be modulated through the use of nucleic acid bioconjugates of the invention. Non-limiting examples of such bioconjugates are described in Vargeese et al., U.S. Ser. No. 10/201,394, filed Aug. 13, 2001; and Matulic-Adamic et al., U.S. Ser. No. 60/362,016, filed Mar. 6, 2002.

Alternatively, certain siNA molecules of the instant invention can be expressed within cells from eukaryotic promoters (e.g., Izant and Weintraub, 1985, *Science,* 229, 345; McGarry and Lindquist, 1986, *Proc. Natl. Acad. Sci., USA* 83, 399; Scanlon et al., 1991, *Proc. Natl. Acad. Sci. USA,* 88, 10591-5; Kashani-Sabet et al., 1992, *Antisense Res. Dev.,* 2, 3-15; propulic et al., 1992, *J. Virol.,* 66, 1432-41; Weerasinghe et al., 1991, *J. Virol.,* 65, 5531-4; Ojwang et al., 1992, *Proc. Natl. Acad. Sci. USA,* 89, 10802-6; Chen et al., 1992, *Nucleic Acids Res.,* 20, 4581-9; Sarver et al., 1990 Science, 247, 1222-1225; Thompson et al., 1995, *Nucleic Acids Res.,* 23, 2259; Good et al., 1997, *Gene Therapy,* 4, 45. Those skilled in the art realize that any nucleic acid can be expressed in eukaryotic cells from the appropriate DNA/RNA vector. The activity of such nucleic acids can be augmented by their release from the primary transcript by a enzymatic nucleic acid (Draper et al., PCT WO 93/23569, and Sullivan et al., PCT WO 94/02595; Ohkawa et al., 1992, *Nucleic Acids Symp. Ser.,* 27, 15-6; Taira et al., 1991, *Nucleic Acids Res.,* 19, 5125-30; Ventura et al., 1993, *Nucleic Acids Res.,* 21, 3249-55; Chowrira et al., 1994, *J. Biol. Chem.,* 269, 25856.

In another aspect of the invention, RNA molecules of the present invention can be expressed from transcription units (see for example Couture et al., 1996, *TIG.,* 12, 510) inserted into DNA or RNA vectors. The recombinant vectors can be DNA plasmids or viral vectors. siNA expressing viral vectors can be constructed based on, but not limited to, adeno-associated virus, retrovirus, adenovirus, or alphavirus. In another embodiment, pol III based constructs are used to express nucleic acid molecules of the invention (see for example Thompson, U.S. Pats. Nos. 5,902,880 and 6,146,886). The recombinant vectors capable of expressing the siNA molecules can be delivered as described above, and persist in target cells. Alternatively, viral vectors can be used that provide for transient expression of nucleic acid molecules. Such vectors can be repeatedly administered as necessary. Once expressed, the siNA molecule interacts with the target mRNA and generates an RNAi response. Delivery of siNA molecule expressing vectors can be systemic, such as by intravenous or intramuscular administration, by administration to target cells ex-planted from a subject followed by reintroduction into the subject, or by any other means that would allow for introduction into the desired target cell (for a review see Couture et al., 1996, *TIG.,* 12, 510).

In one aspect the invention features an expression vector comprising a nucleic acid sequence encoding at least one siNA molecule of the instant invention. The expression vector can encode one or both strands of a siNA duplex, or a single self-complementary strand that self hybridizes into a siNA duplex. The nucleic acid sequences encoding the siNA molecules of the instant invention can be operably linked in a manner that allows expression of the siNA molecule (see for example Paul et al., 2002, *Nature Biotechnology,* 19, 505; Miyagishi and Taira, 2002, *Nature Biotechnology,* 19, 497; Lee et al., 2002, *Nature Biotechnology,* 19, 500; and Novina et al., 2002, *Nature Medicine,* advance online publication doi: 10.1038/nm725).

In another aspect, the invention features an expression vector comprising: a) a transcription initiation region (e.g., eukaryotic pol I, II or III initiation region); b) a transcription termination region (e.g., eukaryotic pol I, II or III termination region); and c) a nucleic acid sequence encoding at least one of the siNA molecules of the instant invention, wherein said sequence is operably linked to said initiation region and said termination region in a manner that allows expression and/or delivery of the siNA molecule. The vector can optionally include an open reading frame (ORF) for a protein operably linked on the 5' side or the 3'-side of the sequence encoding the siNA of the invention; and/or an intron (intervening sequences).

Transcription of the siNA molecule sequences can be driven from a promoter for eukaryotic RNA polymerase I (pol I), RNA polymerase II (po II), or RNA polymerase III (pol III). Transcripts from pol II or pol III promoters are expressed at high levels in all cells; the levels of a given pol II promoter in a given cell type depends on the nature of the gene regulatory sequences (enhancers, silencers, etc.) present nearby. Prokaryotic RNA polymerase promoters are also used, providing that the prokaryotic RNA polymerase enzyme is expressed in the appropriate cells (Elroy-Stein and Moss, 1990, *Proc. Natl. Acad. Sci. U S A,* 87, 6743-7; Gao and Huang 1993, *Nucleic Acids Res.,* 21, 2867-72; Lieber et al., 1993, *Methods Enzymol.,* 217, 47-66; Zhou et al., 1990, *Mol. Cell. Biol.,* 10, 4529-37). Several investigators have demonstrated that nucleic acid molecules expressed from such promoters can function in mammalian cells (e.g. Kashani-Sabet et al., 1992, *Antisense Res. Dev.,* 2, 3-15; Ojwang et al., 1992, *Proc. Natl. Acad. Sci. USA,* 89, 10802-6; Chen et al., 1992, *Nucleic Acids Res.,* 20, 4581-9; Yu et al., 1993, *Proc. Natl. Acad. Sci. USA,* 90, 6340-4; L'Huillier et al., 1992, *EMBO J.,* 11, 4411-8; Lisziewicz et al., 1993, *Proc. Natl. Acad. Sci. U.S. A,* 90, 8000-4; Thompson et al., 1995, *Nucleic Acids Res.,* 23, 2259; Sullenger & Cech, 1993, *Science,* 262, 1566). More specifically, transcription units such as the ones derived from genes encoding U6 small nuclear (snRNA), transfer RNA (tRNA) and adenovirus VA RNA are useful in generating high concentrations of desired RNA molecules such as siNA in cells (Thompson et al., supra; Couture and Stinchcomb, 1996, supra; Noonberg et al., 1994, *Nucleic Acid Res.,* 22, 2830; Noonberg et al., U.S. Pat. No. 5,624,803; Good et al., 1997,

*Gene Ther.*, 4, 45; Beigelman et al., International PCT Publication No. WO 96/18736. The above siNA transcription units can be incorporated into a variety of vectors for introduction into mammalian cells, including but not restricted to, plasmid DNA vectors, viral DNA vectors (such as adenovirus or adeno-associated virus vectors), or viral RNA vectors (such as retroviral or alphavirus vectors) (for a review see Couture and Stinchcomb, 1996, supra).

In another aspect the invention features an expression vector comprising a nucleic acid sequence encoding at least one of the siNA molecules of the invention in a manner that allows expression of that siNA molecule. The expression vector comprises in one embodiment; a) a transcription initiation region; b) a transcription termination region; and c) a nucleic acid sequence encoding at least one strand of the siNA molecule, wherein the sequence is operably linked to the initiation region and the termination region in a manner that allows expression and/or delivery of the siNA molecule.

In another embodiment the expression vector comprises: a) a transcription initiation region; b) a transcription termination region; c) an open reading frame; and d) a nucleic acid sequence encoding at least one strand of a siNA molecule, wherein the sequence is operably linked to the 3'-end of the open reading frame and wherein the sequence is operably linked to the initiation region, the open reading frame and the termination region in a manner that allows expression and/or delivery of the siNA molecule. In yet another embodiment, the expression vector comprises: a) a transcription initiation region; b) a transcription termination region; c) an intron; and d) a nucleic acid sequence encoding at least one siNA molecule, wherein the sequence is operably linked to the initiation region, the intron and the termination region in a manner which allows expression and/or delivery of the nucleic acid molecule.

In another embodiment, the expression vector comprises: a) a transcription initiation region; b) a transcription termination region; c) an intron; d) an open reading frame; and e) a nucleic acid sequence encoding at least one strand of a siNA molecule, wherein the sequence is operably linked to the 3'-end of the open reading frame and wherein the sequence is operably linked to the initiation region, the intron, the open reading frame and the termination region in a manner which allows expression and/or delivery of the siNA molecule.

RSV Biology and Biochemistry

Respiratory syncytial virus (RSV) is the most common cause of bronchiolitis and pneumonia among infants and children under 1 year of age. Illness begins most frequently with fever, runny nose, cough, and sometimes wheezing. During their first RSV infection, between 25% and 40% of infants and young children have signs or symptoms of bronchiolitis or pneumonia, and 0.5% to 2% require hospitalization. Most children recover from illness in 8 to 15 days. The majority of children hospitalized for RSV infection are under 6 months of age. RSV also causes repeated infections throughout life, usually associated with moderate-to-severe cold-like symptoms; however, severe lower respiratory tract disease may occur at any age, especially among the elderly or among those with compromised cardiac, pulmonary, or immune systems.

Human respiratory syncytial virus (hRSV or RSV) is the type species of the genus *Pneumovirus*. Along with other members of the family Paramyxoviridae, hRSV is an enveloped virus with a negative sense, single-stranded RNA genome. These viruses are 150-200 nm in diameter with a helical nucleocapsid. Other members of the family include human parainfluenzavirus 1 (HPIV-1; genus *Respirovirus*), mumps virus (MuV), human parainfluenzavirus 2 and 4 (HPIV-2 and HPIV-4; genus *Rubulavirus*), measles virus (MeV; genus *Morbillivirus*), Hendravirus and Nipahvirus (genus *Henipavirus*) and human metapneumovirus (hMPV; genus *Metapneumovirus*).

The hRSV virion enters its target cell by fusion of the hRSV envelope with the cell membrane and release of the viral genome into the cell's cytoplasm where translation will occur. The nucleopretein (N), large (L) and phosphoproteins (P) together with the RNA genome form the nucleoprotein core. These together with the matrix (M), fusion (F), and glycoprotein (G) are classified as structural proteins. The nonstructural proteins include NS1 and 2, small hydrophobic (SH) and M2 (formerly 22-kDa). The respiratory syncytial virus genome is transcribed from the 3' end into monocistronic (each species only encodes a single protein) mRNA molecules. New viruses are released form the infected cell buy budding. In the presence of newly synthesized hRSV fusion (F) protein, neighbouring infected cells may form a clump whose membranes have fused to form a "giant cell" called a syncytium. New virions can then spread more effectively from cell-to-cell.

RSV is spread from respiratory secretions through close contact with infected persons or contact with contaminated surfaces or objects. Infection can occur when infectious material contacts mucous membranes of the eyes, mouth, or nose, and possibly through the inhalation of droplets generated by a sneeze or cough. In temperate climates, RSV infections usually occur during annual community outbreaks, often lasting 4 to 6 months, during the late fall, winter, or early spring months. The timing and severity of outbreaks in a community vary from year to year. RSV spreads efficiently among children during the annual outbreaks, and most children will have serologic evidence of RSV infection by 2 years of age.

Diagnosis of RSV infection can be made by virus isolation, detection of viral antigens, detection of viral RNA, demonstration of a rise in serum antibodies, or a combination of these approaches. Most clinical laboratories use antigen detection assays to diagnose infection.

For children with mild disease, no specific treatment is necessary other than the treatment of symptoms (e.g., acetaminophen to reduce fever). Children with severe disease may require oxygen therapy and sometimes mechanical ventilation. Ribavirin aerosol may be used in the treatment of some patients with severe disease. Some investigators have used a combination of immune globulin intravenous (IGIV) with high titers of neutralizing RSV antibody (RSV-IGIV) and ribavirin to treat patients with compromised immune systems.

The use of nucleic molecules of the invention targeting RSV genes and cellular/host gene targets associated with the RSV life cycle therefore provides a class of novel therapeutic agents that can be used in the treatment and diagnosis of RSV infection, respiratory distress, stridor, bronchiolitis and pneumonia, or any other disease or condition that responds to modulation (e.g., inhibition) of RSV genes in a subject or organism.

EXAMPLES

The following are non-limiting examples showing the selection, isolation, synthesis and activity of nucleic acids of the instant invention.

Example 1

Tandem Synthesis of siNA Constructs

Exemplary siNA molecules of the invention are synthesized in tandem using a cleavable linker, for example, a succinyl-based linker. Tandem synthesis as described herein is followed by a one-step purification process that provides RNAi molecules in high yield. This approach is highly amenable to siNA synthesis in support of high throughput RNAi screening, and can be readily adapted to multi-column or multi-well synthesis platforms.

After completing a tandem synthesis of a siNA oligo and its complement in which the 5'-terminal dimethoxytrityl (5'-O-DMT) group remains intact (trityl on synthesis), the oligonucleotides are deprotected as described above. Following deprotection, the siNA sequence strands are allowed to spontaneously hybridize. This hybridization yields a duplex in which one strand has retained the 5'-O-DMT group while the complementary strand comprises a terminal 5'-hydroxyl. The newly formed duplex behaves as a single molecule during routine solid-phase extraction purification (Trityl-On purification) even though only one molecule has a dimethoxytrityl group. Because the strands form a stable duplex, this dimethoxytrityl group (or an equivalent group, such as other trityl groups or other hydrophobic moieties) is all that is required to purify the pair of oligos, for example, by using a C18 cartridge.

Standard phosphoramidite synthesis chemistry is used up to the point of introducing a tandem linker, such as an inverted deoxy abasic succinate or glyceryl succinate linker (see FIG. 1) or an equivalent cleavable linker. A non-limiting example of linker coupling conditions that can be used includes a hindered base such as diisopropylethylamine (DIPA) and/or DMAP in the presence of an activator reagent such as Bromotripyrrolidinophosphoniumhexafluororophosphate (PyBrOP). After the linker is coupled, standard synthesis chemistry is utilized to complete synthesis of the second sequence leaving the terminal the 5'-O-DMT intact. Following synthesis, the resulting oligonucleotide is deprotected according to the procedures described herein and quenched with a suitable buffer, for example with 50 mM NaOAc or 1.5M $NH_4H_2CO_3$.

Purification of the siNA duplex can be readily accomplished using solid phase extraction, for example, using a Waters C18 SepPak 1 g cartridge conditioned with 1 column volume (CV) of acetonitrile, 2 CV H2O, and 2 CV 50 mM NaOAc. The sample is loaded and then washed with 1 CV H2O or 50 mM NaOAc. Failure sequences are eluted with 1 CV 14% ACN (Aqueous with 50 mM NaOAc and 50 mM NaCl). The column is then washed, for example with 1 CV H2O followed by on-column detritylation, for example by passing 1 CV of 1% aqueous trifluoroacetic acid (TFA) over the column, then adding a second CV of 1% aqueous TFA to the column and allowing to stand for approximately 10 minutes. The remaining TFA solution is removed and the column washed with H2O followed by 1 CV 1M NaCl and additional H2O. The siNA duplex product is then eluted, for example, using 1 CV 20% aqueous CAN.

Figure 2:
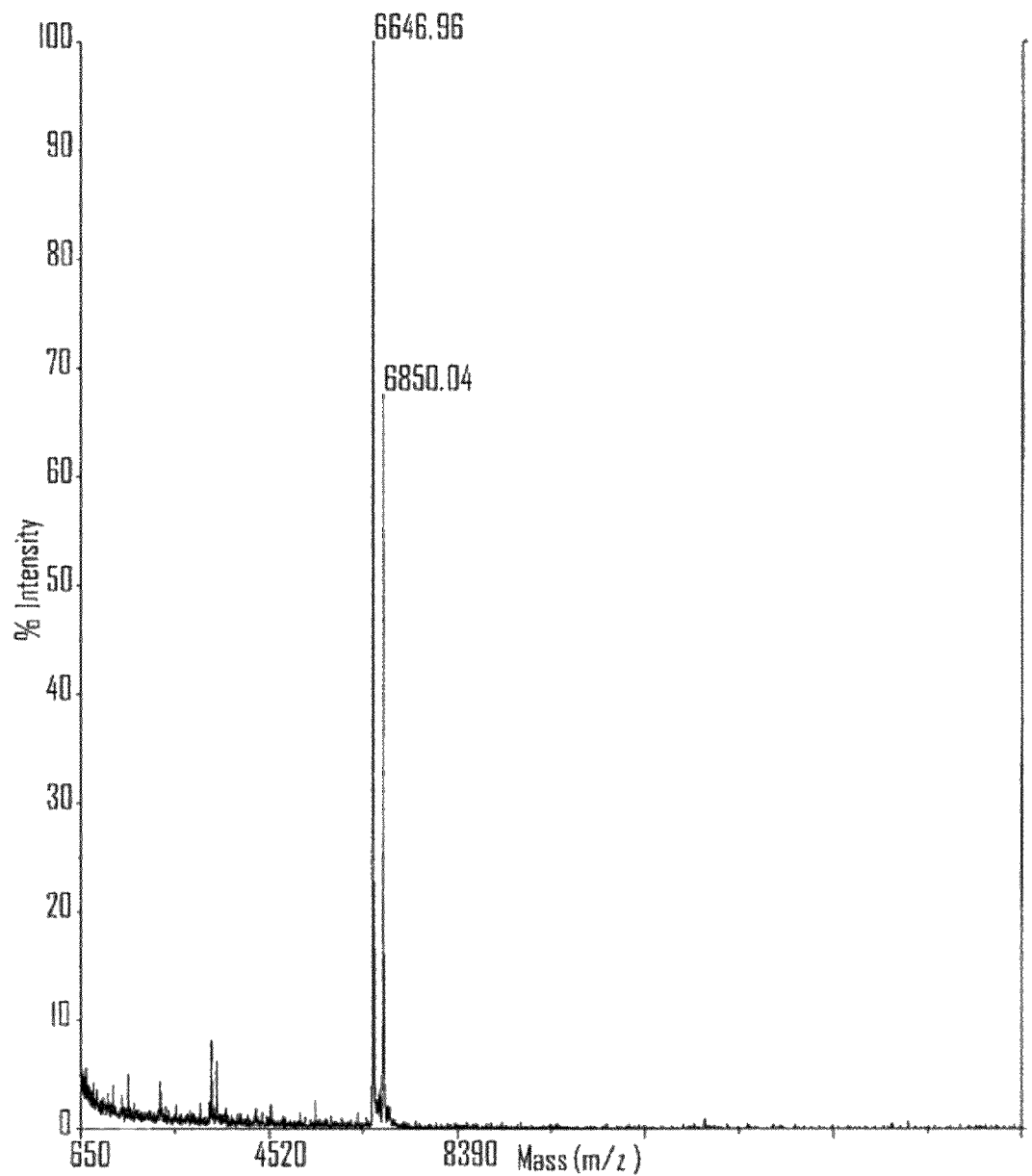
FIG. 2 shows a MALDI-TOF mass spectrum of a purified siNA duplex synthesized by a method of the invention. The two peaks shown correspond to the predicted mass of the separate siNA sequence strands. This result demonstrates that the siNA duplex generated from tandem synthesis can be purified as a single entity using a simple trityl-on purification methodology.
Figure 3:
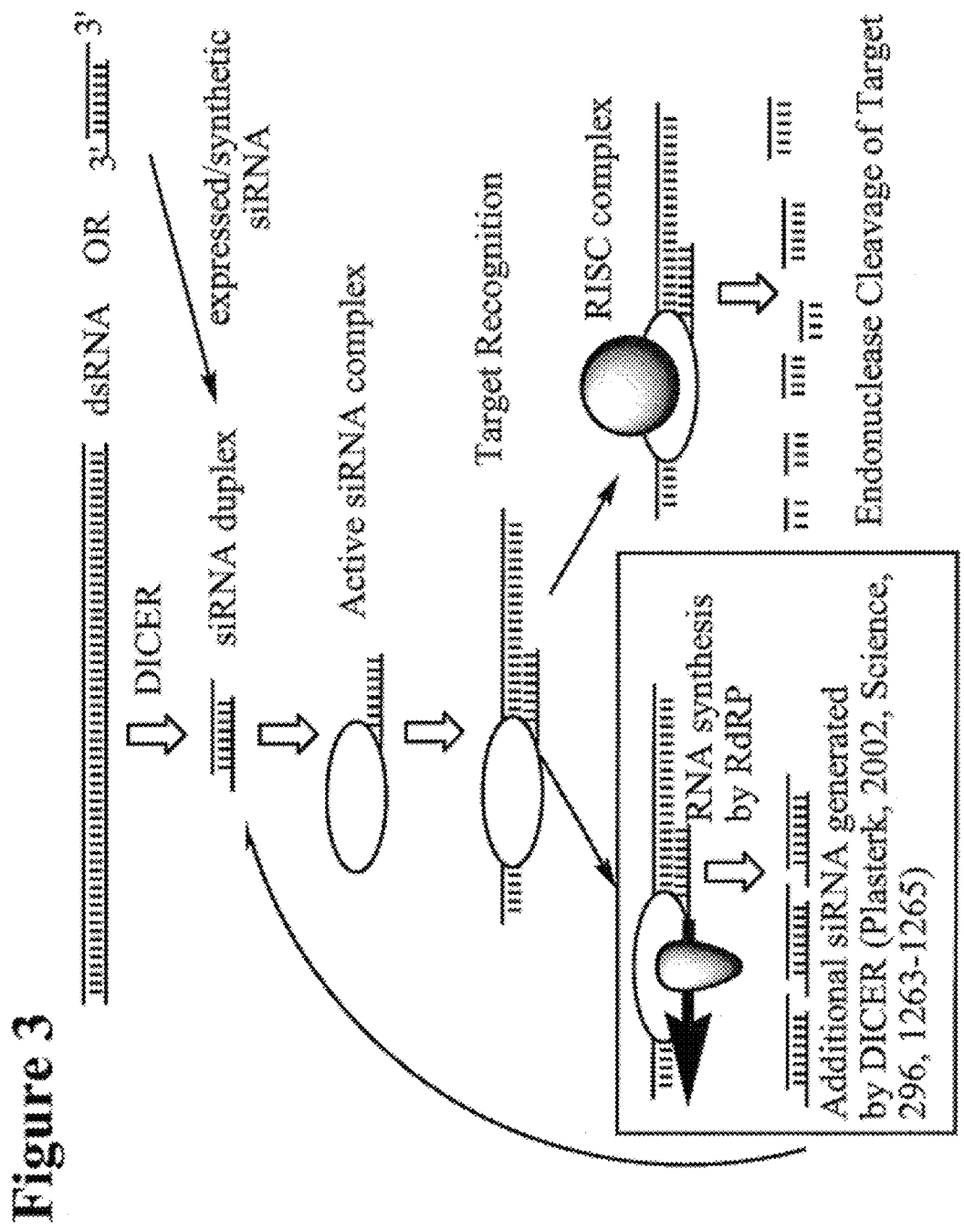
FIG. 3 shows a non-limiting proposed mechanistic representation of target RNA degradation involved in RNAi. Double-stranded RNA (dsRNA), which is generated by RNA-dependent RNA polymerase (RdRP) from foreign single-stranded RNA, for example viral, transposon, or other exogenous RNA, activates the DICER enzyme that in turn generates siNA duplexes. Alternately, synthetic or expressed siNA can be introduced directly into a cell by appropriate means. An active siNA complex forms which recognizes a target RNA, resulting in degradation of the target RNA by the RISC endonuclease complex or in the synthesis of additional RNA by RNA-dependent RNA polymerase (RdRP), which can activate DICER and result in additional siNA molecules, thereby amplifying the RNAi response.

FIG. 2 provides an example of MALDI-TOF mass spectrometry analysis of a purified siNA construct in which each peak corresponds to the calculated mass of an individual siNA strand of the siNA duplex. The same purified siNA provides three peaks when analyzed by capillary gel electrophoresis (CGE), one peak presumably corresponding to the duplex siNA, and two peaks presumably corresponding to the separate siNA sequence strands. Ion exchange HPLC analysis of the same siNA contract only shows a single peak. Testing of the purified siNA construct using a luciferase reporter assay described below demonstrated the same RNAi activity compared to siNA constructs generated from separately synthesized oligonucleotide sequence strands.

Example 2

Identification of Potential siNA Target Sites in any RNA Sequence

The sequence of an RNA target of interest, such as a viral or human mRNA transcript, is screened for target sites, for example by using a computer folding algorithm. In a non-limiting example, the sequence of a gene or RNA gene transcript derived from a database, such as Genbank, is used to generate siNA targets having complementarity to the target. Such sequences can be obtained from a database, or can be determined experimentally as known in the art. Target sites that are known, for example, those target sites determined to be effective target sites based on studies with other nucleic acid molecules, for example ribozymes or antisense, or those targets known to be associated with a disease, trait, or condition such as those sites containing mutations or deletions, can be used to design siNA molecules targeting those sites. Various parameters can be used to determine which sites are the most suitable target sites within the target RNA sequence. These parameters include but are not limited to secondary or tertiary RNA structure, the nucleotide base composition of the target sequence, the degree of homology between various regions of the target sequence, or the relative position of the target sequence within the RNA transcript. Based on these determinations, any number of target sites within the RNA transcript can be chosen to screen siNA molecules for efficacy, for example by using in vitro RNA cleavage assays, cell culture, or animal models. In a non-limiting example, anywhere from 1 to 1000 target sites are chosen within the transcript based on the size of the siNA construct to be used. High throughput screening assays can be developed for screening siNA molecules using methods known in the art, such as with multi-well or multi-plate assays to determine efficient reduction in target gene expression.

Example 3

Selection of siNA Molecule Target Sites in a RNA

The following non-limiting steps can be used to carry out the selection of siNAs targeting a given gene sequence or transcript.

1. The target sequence is parsed in silico into a list of all fragments or subsequences of a particular length, for example 23 nucleotide fragments, contained within the target sequence. This step is typically carried out using a custom Perl script, but commercial sequence analysis programs such as Oligo, MacVector, or the GCG Wisconsin Package can be employed as well.

2. In some instances the siNAs correspond to more than one target sequence; such would be the case for example in targeting different transcripts of the same gene, targeting different transcripts of more than one gene, or for targeting both the human gene and an animal homolog. In this case, a subsequence list of a particular length is generated for each of the targets, and then the lists are compared to find matching sequences in each list. The subsequences are then ranked according to the number of target sequences that contain the given subsequence; the goal is to find subsequences that are present in most or all of the target sequences. Alternately, the ranking can identify subsequences that are unique to a target sequence, such as a mutant target sequence. Such an approach would enable the use of siNA to target specifically the mutant sequence and not effect the expression of the normal sequence.

3. In some instances the siNA subsequences are absent in one or more sequences while present in the desired target sequence; such would be the case if the siNA targets a gene with a paralogous family member that is to remain untargeted. As in case 2 above, a subsequence list of a particular length is generated for each of the targets, and then the lists are compared to find sequences that are present in the target gene but are absent in the untargeted paralog.

4. The ranked siNA subsequences can be further analyzed and ranked according to GC content. A preference can be given to sites containing 30-70% GC, with a further preference to sites containing 40-60% GC.

5. The ranked siNA subsequences can be further analyzed and ranked according to self-folding and internal hairpins. Weaker internal folds are preferred; strong hairpin structures are to be avoided.

6. The ranked siNA subsequences can be further analyzed and ranked according to whether they have runs of GGG or CCC in the sequence. GGG (or even more Gs) in either strand can make oligonucleotide synthesis problematic and can potentially interfere with RNAi activity, so it is avoided whenever better sequences are available. CCC is searched in the target strand because that will place GGG in the antisense strand.

7. The ranked siNA subsequences can be further analyzed and ranked according to whether they have the dinucleotide UU (uridine dinucleotide) on the 3'-end of the sequence, and/or AA on the 5'-end of the sequence (to yield 3' UU on the antisense sequence). These sequences allow one to design siNA molecules with terminal TT thymidine dinucleotides.

8. Four or five target sites are chosen from the ranked list of subsequences as described above. For example, in subsequences having 23 nucleotides, the right 21 nucleotides of each chosen 23-mer subsequence are then designed and synthesized for the upper (sense) strand of the siNA duplex, while the reverse complement of the left 21 nucleotides of each chosen 23-mer subsequence are then designed and synthesized for the lower (antisense) strand of the siNA duplex (see Table II). If terminal TT residues are desired for the sequence (as described in paragraph 7), then the two 3' terminal nucleotides of both the sense and antisense strands are replaced by TT prior to synthesizing the oligos.

9. The siNA molecules are screened in an in vitro, cell culture or animal model system to identify the most active siNA molecule or the most preferred target site within the target RNA sequence.

10. Other design considerations can be used when selecting target nucleic acid sequences, see, for example, Reynolds et al., 2004, *Nature Biotechnology Advanced Online Publication*, 1 Feb. 2004, doi:10.1038/nbt936 and Ui-Tei et al., 2004, Nucleic Acids Research, 32, doi:10.1093/nar/gkh247.

Figure 9:
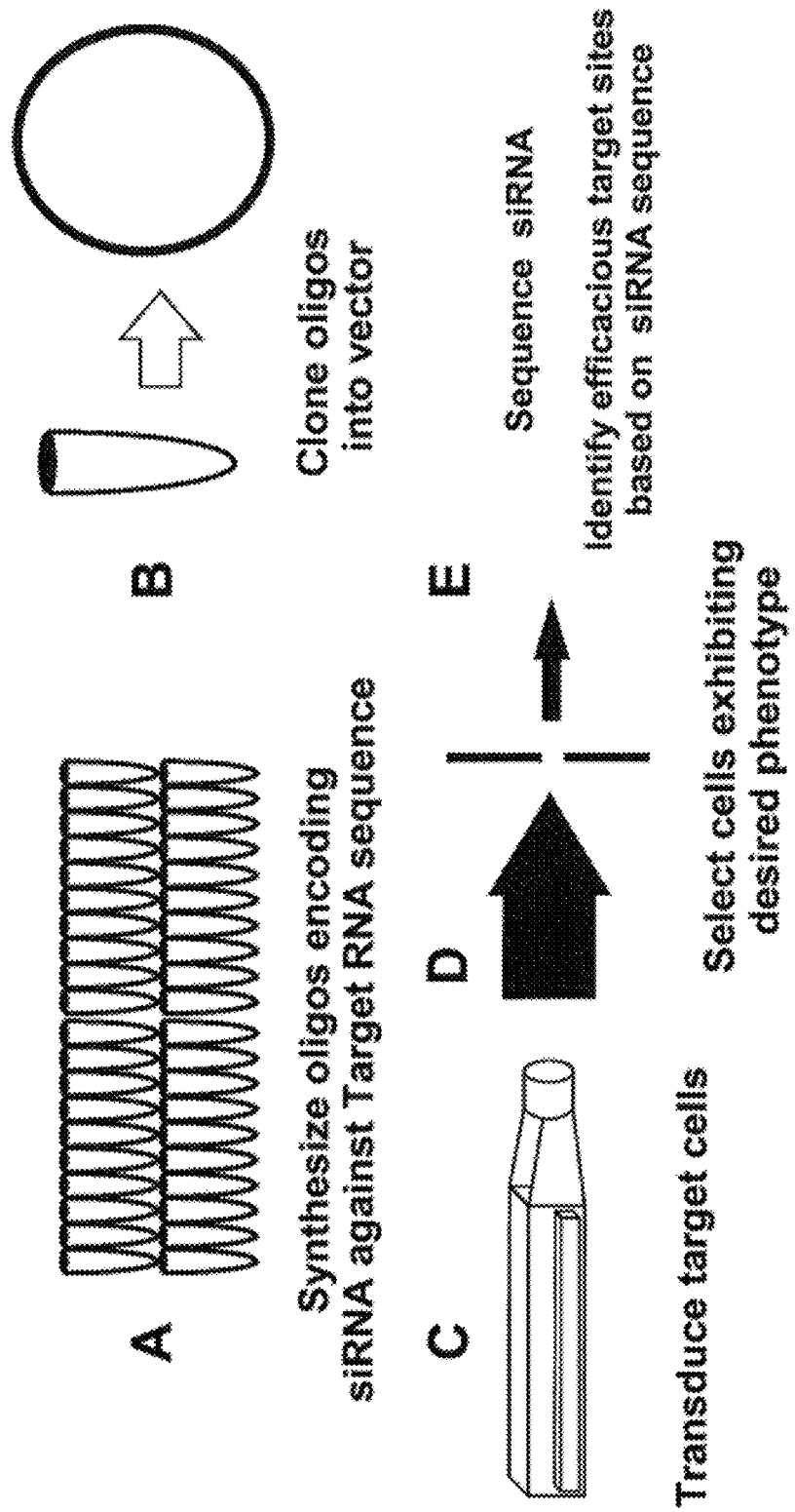

In an alternate approach, a pool of siNA constructs specific to a target sequence is used to screen for target sites in cells expressing target RNA, such as cultured Jurkat, HeLa, A549 or 293T cells. The general strategy used in this approach is shown in FIG. 9. Cells expressing the target RNA are transfected with the pool of siNA constructs and cells that demonstrate a phenotype associated with target inhibition are sorted. The pool of siNA constructs can be expressed from transcription cassettes inserted into appropriate vectors (see for example FIG. 7 and FIG. 8). The siNA from cells demonstrating a positive phenotypic change (e.g., decreased proliferation, decreased target mRNA levels or decreased target protein expression), are sequenced to determine the most suitable target site(s) within the target target RNA sequence.

In one embodiment, siNA molecules of the invention are selected using the following methodology. The following guidelines were compiled to predict hyper-active siNAs that contain chemical modifications described herein. These rules emerged from a comparative analysis of hyper-active (>75% knockdown of target mRNA levels) and inactive (<75% knockdown of target mRNA levels) siNAs against several different targets. A total of 242 siNA sequences were analyzed. Thirty-five siNAs out of 242 siRNAs were grouped into hyper-active and the remaining siNAs were grouped into inactive groups. The hyper-active siNAs clearly showed a preference for certain bases at particular nucleotide positions within the siNA sequence. For example, A or U nucleobase was overwhelmingly present at position 19 of the sense strand in hyper-active siNAs and opposite was true for inactive siNAs. There was also a pattern of a A/U rich (3 out of 5 bases as A or U) region between positions 15-19 and G/C rich region between positions 1-5 (3 out of 5 bases as G or C) of the sense strand in hyperactive siNAs. As shown in Table VII, 12 such patterns were identified that were characteristics of hyper-active siNAs. It is to be noted that not every pattern was present in each hyper-active siNA. Thus, to design an algorithm for predicting hyper-active siNAs, a different score was assigned for each pattern. Depending on how frequently such patterns occur in hyper-active siRNAs versus inactive siRNAs, the design parameters were assigned a score with the highest being 10. If a certain nucleobase is not preferred at a position, then a negative score was assigned. For example, at positions 9 and 13 of the sense strand, a G nucleotide was not preferred in hyper-active siNAs and therefore they were given score of −3(minus 3). The differential score for each pattern is given in Table VII. The pattern # 4 was given a maximum score of −100. This is mainly to weed out any sequence that contains string of 4Gs or 4Cs as they can be highly incompatible for synthesis and can allow sequences to self-aggregate, thus rendering the siNA inactive. Using this algorithm, the highest score possible for any siNA is 66. As there are numerous siNA sequences possible against any given target of reasonable size (~1000 nucleotides), this algorithm is useful to generate hyper-active siNAs.

In one embodiment, rules 1-11 are used to generate active siNA molecules of the invention. In another embodiment, rules 1-12 are used to generate active siNA molecules of the invention.

Example 4

RSV siNA Design siNA target sites were chosen by analyzing sequences of the RSV target and optionally prioritizing the target sites on the basis of the rules presented in Example 3 above, and alternately on the basis of folding (structure of any given sequence analyzed to determine siNA accessibility to the target), or by using a library of siNA molecules as described in Example 3, or alternately by using an in vitro siNA system as described in Example 6 herein. siNA molecules were designed that could bind each target and are selected using the algorithm above and are optionally individually analyzed by computer folding to assess whether the siNA molecule can interact with the target sequence. Varying the length of the siNA molecules can be chosen to optimize activity. Generally, a sufficient number of complementary nucleotide bases are chosen to bind to, or otherwise interact with, the target RNA, but the degree of complementarity can be modulated to accommodate siNA duplexes or varying length or base composition. By using such methodologies, siNA molecules can be designed to target sites within any known RNA sequence, for example those RNA sequences corresponding to the any gene transcript.

RSV RNA sequences (Table I) were analysed for homology with an 80% cutoff to generate a consensus RSV target RNA molecule from which double stranded siNA molecules were designed (Table II). To generate synthetic siNA constructs (Table III), the algorithm described in Example 3 was utilized to pick active double stranded constructs and chemically modified versions thereof. In each of Tables II and III, the target sequence is shown, along with the upper (sense strand) and lower (antisense strand) of the siNA duplex. The following sequences, referred to by GenBank accession number, were used to generate the siNA sequences shown in Tables II and III.

```
gi|3089371|gb|AF035006.1|
gi|60549163|gb|AY911262.1|
Ref Seq (NC_001803.1)
gi|1912287|gb|U39662.1|HRU39662
gi|1695254|gb|U63644.1|HRU63644
gi|2582022|gb|AF013254.1|AF013254
gi|2627296|gb|U50362.1|HRU50362
gi|38230482|gb|AY353550.1|
gi|1912298|gb|U39661.1|RSU39661
gi|9629198|ref|NC_001781.1|
gi|2627309|gb|U50363.1|HRU50363
gi|2582034|gb|AF013255.1|AF013255
```

Chemically modified siNA constructs were designed to provide nuclease stability for systemic administration in vivo and/or improved pharmacokinetic, localization, and delivery properties while preserving the ability to mediate RNAi activity. Chemical modifications as described herein are introduced synthetically using synthetic methods described herein and those generally known in the art. The synthetic siNA constructs are then assayed for nuclease stability in serum and/or cellular/tissue extracts (e.g. liver extracts). The synthetic siNA constructs are also tested in parallel for RNAi activity using an appropriate assay, such as a luciferase reporter assay as described herein or another suitable assay that can quantity RNAi activity. Synthetic siNA constructs that possess both nuclease stability and RNAi activity can be further modified and re-evaluated in stability and activity assays. The chemical modifications of the stabilized active siNA constructs can then be applied to any siNA sequence targeting any chosen RNA and used, for example, in target screening assays to pick lead siNA compounds for therapeutic development (see for example FIG. 11).

Example 5

Chemical Synthesis and Purification of siNA siNA molecules can be designed to interact with various sites in the RNA message, for example, target sequences within the RNA sequences described herein. The sequence of one strand of the siNA molecule(s) is complementary to the target site sequences described above. The siNA molecules can be chemically synthesized using methods described herein. Inactive siNA molecules that are used as control sequences can be synthesized by scrambling the sequence of the siNA molecules such that it is not complementary to the target sequence. Generally, siNA constructs can by synthesized using solid phase oligonucleotide synthesis methods as described herein (see for example Usman et al., U.S. Pat. Nos. 5,804,683; 5,831,071; 5,998,203; 6,117,657; 6,353,098; 6,362,323; 6,437,117; 6,469,158; Scaringe et al., U.S. Pat. Nos. 5,889,136; 6,008,400; 6,111,086 all incorporated by reference herein in their entirety).

In a non-limiting example, RNA oligonucleotides are synthesized in a stepwise fashion using the phosphoramidite chemistry as is known in the art. Standard phosphoramidite chemistry involves the use of nucleosides comprising any of 5'-O-dimethoxytrityl, 2'-O-tert-butyldimethylsilyl, 3'-O-2-Cyanoethyl N,N-diisopropylphosphoroamidite groups, and exocyclic amine protecting groups (e.g. N6-benzoyl adenosine, N4 acetyl cytidine, and N2-isobutyryl guanosine). Alternately, 2'-O—Silyl Ethers can be used in conjunction with acid-labile 2'-O-orthoester protecting groups in the synthesis of RNA as described by Scaringe supra. Differing 2' chemistries can require different protecting groups, for example 2'-deoxy-2'-amino nucleosides can utilize N-phthaloyl protection as described by Usman et al., U.S. Pat. No. 5,631,360, incorporated by reference herein in its entirety).

During solid phase synthesis, each nucleotide is added sequentially (3'- to 5'-direction) to the solid support-bound oligonucleotide. The first nucleoside at the 3'-end of the chain is covalently attached to a solid support (e.g., controlled pore glass or polystyrene) using various linkers. The nucleotide precursor, a ribonucleoside phosphoramidite, and activator are combined resulting in the coupling of the second nucleoside phosphoramidite onto the 5'-end of the first nucleoside. The support is then washed and any unreacted 5'-hydroxyl groups are capped with a capping reagent such as acetic anhydride to yield inactive 5'-acetyl moieties. The trivalent phosphorus linkage is then oxidized to a more stable phosphate linkage. At the end of the nucleotide addition cycle, the 5'-O-protecting group is cleaved under suitable conditions (e.g., acidic conditions for trityl-based groups and Fluoride for silyl-based groups). The cycle is repeated for each subsequent nucleotide.

Modification of synthesis conditions can be used to optimize coupling efficiency, for example by using differing coupling times, differing reagent/phosphoramidite concentrations, differing contact times, differing solid supports and solid support linker chemistries depending on the particular chemical composition of the siNA to be synthesized.

Deprotection and purification of the siNA can be performed as is generally described in Usman et al., U.S. Pat. Nos. 5,831,071, 6,353,098, 6,437,117, and Bellon et al., U.S. Pat. Nos. 6,054,576, 6,162,909, 6,303,773, or Scaringe supra, incorporated by reference herein in their entireties. Additionally, deprotection conditions can be modified to provide the best possible yield and purity of siNA constructs. For example, applicant has observed that oligonucleotides comprising 2'-deoxy-2'-fluoro nucleotides can degrade under inappropriate deprotection conditions. Such oligonucleotides are deprotected using aqueous methylamine at about 35° C. for 30 minutes. If the 2'-deoxy-2'-fluoro containing oligonucleotide also comprises ribonucleotides, after deprotection with aqueous methylamine at about 35° C. for 30 minutes, TEA-HF is added and the reaction maintained at about 65° C. for an additional 15 minutes.

Example 6

RNAi In Vitro Assay to Assess siNA Activity

An in vitro assay that recapitulates RNAi in a cell-free system is used to evaluate siNA constructs targeting target RNA targets. The assay comprises the system described by Tuschl et al., 1999, *Genes and Development*, 13, 3191-3197 and Zamore et al., 2000, *Cell*, 101, 25-33 adapted for use with a target RNA. A *Drosophila* extract derived from syncytial blastoderm is used to reconstitute RNAi activity in vitro. Target RNA is generated via in vitro transcription from an appropriate target expressing plasmid using T7 RNA polymerase or via chemical synthesis as described herein. Sense and antisense siNA strands (for example 20 uM each) are annealed by incubation in buffer (such as 100 mM potassium acetate, 30 mM HEPES-KOH, pH 7.4, 2 mM magnesium acetate) for 1 minute at 90° C. followed by 1 hour at 37° C., then diluted in lysis buffer (for example 100 mM potassium acetate, 30 mM HEPES-KOH at pH 7.4, 2 mM magnesium acetate). Annealing can be monitored by gel electrophoresis on an agarose gel in TBE buffer and stained with ethidium bromide. The *Drosophila* lysate is prepared using zero to two-hour-old embryos from Oregon R flies collected on yeasted molasses agar that are dechorionated and lysed. The lysate is centrifuged and the supernatant isolated. The assay comprises a reaction mixture containing 50% lysate [vol/vol], RNA (10-50 µM final concentration), and 10% [vol/vol] lysis buffer containing siNA (10 nM final concentration). The reaction mixture also contains 10 mM creatine phosphate, 10 ug/ml creatine phosphokinase, 100 um GTP, 100 uM UTP, 100 uM CTP, 500 uM ATP, 5 mM DTT, 0.1 U/uL RNasin (Promega), and 100 uM of each amino acid. The final concentration of potassium acetate is adjusted to 100 mM. The reactions are pre-assembled on ice and preincubated at 25° C. for 10 minutes before adding RNA, then incubated at 25° C. for an additional 60 minutes. Reactions are quenched with 4 volumes of 1.25× Passive Lysis Buffer (Promega). Target RNA cleavage is assayed by RT-PCR analysis or other methods known in the art and are compared to control reactions in which siNA is omitted from the reaction.

Alternately, internally-labeled target RNA for the assay is prepared by in vitro transcription in the presence of [alpha-$^{32}$P] CTP, passed over a G50 Sephadex column by spin chromatography and used as target RNA without further purification. Optionally, target RNA is 5'-$^{32}$P-end labeled using T4 polynucleotide kinase enzyme. Assays are performed as described above and target RNA and the specific RNA cleavage products generated by RNAi are visualized on an autoradiograph of a gel. The percentage of cleavage is determined by PHOSPHOR IMAGER® (autoradiography) quantitation of bands representing intact control RNA or RNA from control reactions without siNA and the cleavage products generated by the assay.

In one embodiment, this assay is used to determine target sites in the target RNA target for siNA mediated RNAi cleavage, wherein a plurality of siNA constructs are screened for RNAi mediated cleavage of the target RNA target, for example, by analyzing the assay reaction by electrophoresis of labeled target RNA, or by northern blotting, as well as by other methodology well known in the art.

Example 7

Nucleic Acid Inhibition of RSV Target RNA siNA molecules targeted to RSV RNA are designed and synthesized as described above. These nucleic acid molecules can be tested for cleavage activity in vivo, for example, using the following procedure. The target sequences and the nucleotide location within the RSV RNA are given in Table II and III.

Two formats are used to test the efficacy of siNAs targeting RSV. First, the reagents are tested in cell culture using, for example, RSV infected Jurkat, HeLa, A549 or 293T cells, to determine the extent of RNA and protein inhibition. siNA reagents (e.g.; see Tables II and III) are selected against the RSV target as described herein. RNA inhibition is measured after delivery of these reagents by a suitable transfection agent to, for example, RSV infected Jurkat, HeLa, A549 or 293T cells. Relative amounts of target RNA are measured versus actin using real-time PCR monitoring of amplification (eg., ABI 7700 TAQMAN®). A comparison is made to a mixture of oligonucleotide sequences made to unrelated targets or to a randomized siNA control with the same overall length and chemistry, but randomly substituted at each position. Primary and secondary lead reagents are chosen for the target and optimization performed. After an optimal transfection agent concentration is chosen, a RNA time-course of inhibition is performed with the lead siNA molecule. In addition, a cell-plating format can be used to determine RNA inhibition.

Delivery of siNA to Cells

Cells (e.g., Jurkat, HeLa, A549 or 293T cells) are seeded, for example, at 1×10$^5$ cells per well of a six-well dish in EGM-2 (BioWhittaker) the day before transfection. siNA (final concentration, for example 20 nM) and cationic lipid (e.g., LNP formulations herein, or another suitable lipid such as Lipofectamine, final concentration 2 µg/ml) are complexed in EGM basal media (Biowhittaker) at 37° C. for 30 minutes in polystyrene tubes. Following vortexing, the complexed siNA is added to each well and incubated for the times indicated. For initial optimization experiments, cells are seeded, for example, at 1×10$^3$ in 96 well plates and siNA complex added as described. Efficiency of delivery of siNA to cells is determined using a fluorescent siNA complexed with lipid. Cells in 6-well dishes are incubated with siNA for 24 hours, rinsed with PBS and fixed in 2% paraformaldehyde for 15 minutes at room temperature. Uptake of siNA is visualized using a fluorescent microscope.

TAQMAN® (Real-Time PCR Monitoring of Amplification) and Lightcycler Quantification of mRNA Total RNA is prepared from cells following siNA delivery, for example, using Qiagen RNA purification kits for 6-well or Rneasy extraction kits for 96-well assays. For TAQMAN® analysis (real-time PCR monitoring of amplification), dual-labeled probes are synthesized with the reporter dye, FAM or JOE, covalently linked at the 5'-end and the quencher dye TAMRA conjugated to the 3'-end. One-step RT-PCR amplifications are performed on, for example, an ABI PRISM 7700 Sequence Detector using 50 µl reactions consisting of 10 µl total RNA, 100 nM forward primer, 900 nM reverse primer, 100 nM probe, 1× TaqMan PCR reaction buffer (PE-Applied Biosystems), 5.5 mM MgCl$_2$, 300 µM each dATP, dCTP, dGTP, and dTTP, 10 U RNase Inhibitor (Promega), 1.25 U AMPLITAQ GOLD® (DNA polymerase) (PE-Applied Biosystems) and 10 U M-MLV Reverse Transcriptase (Promega). The thermal cycling conditions can consist of 30 minutes at 48° C., 10 minutes at 95° C., followed by 40 cycles of 15 seconds at 95° C. and 1 minute at 60° C. Quantitation of mRNA levels is determined relative to standards generated from serially diluted total cellular RNA (300, 100, 33, 11 ng/reaction) and normalizing to β-actin or GAPDH mRNA in parallel TAQMAN® reactions (real-time PCR monitoring of amplification). For each gene of interest an upper and lower primer and a fluorescently labeled probe are designed. Real time incorporation of SYBR Green I dye into a specific PCR product can be measured in glass capillary tubes using a lightcyler. A standard curve is generated for each primer pair using control cRNA. Values are represented as relative expression to GAPDH in each sample.

Western Blotting

Nuclear extracts can be prepared using a standard micro preparation technique (see for example Andrews and Faller, 1991, *Nucleic Acids Research*, 19, 2499). Protein extracts from supernatants are prepared, for example using TCA precipitation. An equal volume of 20% TCA is added to the cell supernatant, incubated on ice for 1 hour and pelleted by centrifugation for 5 minutes. Pellets are washed in acetone, dried and resuspended in water. Cellular protein extracts are run on a 10% Bis-Tris NuPage (nuclear extracts) or 4-12% Tris-Glycine (supernatant extracts) polyacrylamide gel and transferred onto nitro-cellulose membranes. Non-specific binding can be blocked by incubation, for example, with 5% non-fat milk for 1 hour followed by primary antibody for 16 hour at 4° C. Following washes, the secondary antibody is applied, for example (1:10,000 dilution) for 1 hour at room temperature and the signal detected with SuperSignal reagent (Pierce).

Example 8

Models Useful to Evaluate the Down-Regulation of RSV Gene Expression

Evaluating the efficacy of anti-iRSV agents in vitro and in animal models is an important prerequisite to human clinical trials. Bitco et al., 2005, *Nature Medicine*, 11, 50-55, describes the use of certain nasally administered vector expressed siRNA constructs targeting RSV. Zhang et al., 2005, *Nature Medicine*, 11, 56-62, describes the use of certain nasally administered vector expressed siRNA constructs targeting the N1 gene of RSV. As such, these models can be used in evaluating the efficacy of siNA molecules of the invention in inhibiting RSV expression. As such, these models and others can be adapted to evaluate the safety and efficacy of siNA molecules of the invention in a pre-clinical setting. For example, the models used by Bitco et al. and Zhang et al. supra, can be adapted for use with synthetic siNA LNP formulations that are administered to the lungs of mice via intranasal inhalation or nebulization as is generally known in the art.

Example 9

RNAi Mediated Inhibition of Target Gene Expression

In Vitro siNA Mediated Inhibition of Target RNA siNA constructs (Table III) are tested for efficacy in reducing RSV RNA expression in, for example, A549 cells that are infected with RSV. Cells are plated approximately 24 hours before transfection in 96-well plates at 5,000-7,500 cells/well, 100 μl/well, such that at the time of transfection cells are 70-90% confluent. For transfection, annealed siNAs are mixed with the transfection reagent (Lipofectamine 2000, Invitrogen) in a volume of 50 μl/well and incubated for 20 minutes at room temperature. The siNA transfection mixtures are added to cells to give a final siNA concentration of 25 nM in a volume of 150 μl. Each siNA transfection mixture is added to 3 wells for triplicate siNA treatments. Cells are incubated at 37° for 24 hours in the continued presence of the siNA transfection mixture. At 24 hours, RNA is prepared from each well of treated cells. The supernatants with the transfection mixtures are first removed and discarded, then the cells are lysed and RNA prepared from each well. Target RSV gene expression following treatment is evaluated by RT-PCR for the target gene and for a control gene (36B4, an RNA polymerase subunit) for normalization. The triplicate data is averaged and the standard deviations determined for each treatment. Normalized data are graphed and the percent reduction of target mRNA by active siNAs in comparison to their respective inverted control siNAs is determined.

Example 10

Indications

The present body of knowledge in RSV research indicates the need for methods to assay RSV activity and for compounds that can regulate RSV expression for research, diagnostic, and therapeutic use. As described herein, the nucleic acid molecules of the present invention can be used in assays to diagnose disease state related of RSV levels. In addition, the nucleic acid molecules can be used to treat disease state related to RSV levels. Particular disease states that can be associated with RSV expression modulation include, but are not limited to, RSV infection, respiratory distress, stridor, bronchiolitis and pneumonia.

Example 11

Multifunctional siNA Inhibition of Target RNA Expression

Multifunctional siNA Design

Once target sites have been identified for multifunctional siNA constructs, each strand of the siNA is designed with a complementary region of length, for example, of about 18 to about 28 nucleotides, that is complementary to a different target nucleic acid sequence. Each complementary region is designed with an adjacent flanking region of about 4 to about 22 nucleotides that is not complementary to the target sequence, but which comprises complementarity to the complementary region of the other sequence (see for example FIG. 16). Hairpin constructs can likewise be designed (see for example FIG. 17). Identification of complementary, palindrome or repeat sequences that are shared between the different target nucleic acid sequences can be used to shorten the overall length of the multifunctional siNA constructs (see for example FIGS. 18 and 19).

In a non-limiting example, three additional categories of additional multifunctional siNA designs are presented that allow a single siNA molecule to silence multiple targets. The first method utilizes linkers to join siNAs (or multifunctional siNAs) in a direct manner. This can allow the most potent siNAs to be joined without creating a long, continuous stretch of RNA that has potential to trigger an interferon response. The second method is a dendrimeric extension of the overlapping or the linked multifunctional design; or alternatively the organization of siNA in a supramolecular format. The third method uses helix lengths greater than 30 base pairs. Processing of these siNAs by Dicer will reveal new, active 5' antisense ends. Therefore, the long siNAs can target the sites defined by the original 5' ends and those defined by the new ends that are created by Dicer processing. When used in combination with traditional multifunctional siNAs (where the sense and antisense strands each define a target) the approach can be used for example to target 4 or more sites.

I. Tethered Bifunctional siNAs

The basic idea is a novel approach to the design of multifunctional siNAs in which two antisense siNA strands are annealed to a single sense strand. The sense strand oligonucleotide contains a linker (e.g., non-nulcoetide linker as described herein) and two segments that anneal to the antisense siNA strands (see FIG. 22). The linkers can also optionally comprise nucleotide-based linkers. Several potential advantages and variations to this approach include, but are not limited to:

1. The two antisense siNAs are independent. Therefore, the choice of target sites is not constrained by a requirement for sequence conservation between two sites. Any two highly active siNAs can be combined to form a multifunctional siNA.
2. When used in combination with target sites having homology, siNAs that target a sequence present in two genes (e.g., different isoforms), the design can be used to target more than two sites. A single multifunctional siNA can be for example, used to target RNA of two different target RNAs.
3. Multifunctional siNAs that use both the sense and antisense strands to target a gene can also be incorporated into a tethered multifuctional design. This leaves open the possibility of targeting 6 or more sites with a single complex.
4. It can be possible to anneal more than two antisense strand siNAs to a single tethered sense strand.
5. The design avoids long continuous stretches of dsRNA. Therefore, it is less likely to initiate an interferon response.
6. The linker (or modifications attached to it, such as conjugates described herein) can improve the pharmacokinetic properties of the complex or improve its incorporation into liposomes. Modifications introduced to the linker should not impact siNA activity to the same extent that they would if directly attached to the siNA (see for example FIGS. 27 and 28).
7. The sense strand can extend beyond the annealed antisense strands to provide additional sites for the attachment of conjugates.
8. The polarity of the complex can be switched such that both of the antisense 3' ends are adjacent to the linker and the 5' ends are distal to the linker or combination thereof.

Dendrimer and Supramolecular siNAs

In the dendrimer siNA approach, the synthesis of siNA is initiated by first synthesizing the dendrimer template followed by attaching various functional siNAs. Various constructs are depicted in FIG. 23. The number of functional siNAs that can be attached is only limited by the dimensions of the dendrimer used.

Supramolecular Approach to Multifunctional siNA

The supramolecular format simplifies the challenges of dendrimer synthesis. In this format, the siNA strands are synthesized by standard RNA chemistry, followed by annealing of various complementary strands. The individual strand synthesis contains an antisense sense sequence of one siNA at the 5'-end followed by a nucleic acid or synthetic linker, such as hexaethyleneglyol, which in turn is followed by sense strand of another siNA in 5' to 3' direction. Thus, the synthesis of siNA strands can be carried out in a standard 3' to 5' direction. Representative examples of trifunctional and tetrafunctional siNAs are depicted in FIG. 24. Based on a similar principle, higher functionality siNA constructs can be designed as long as efficient annealing of various strands is achieved.

Dicer Enabled Multifunctional siNA

Using bioinformatic analysis of multiple targets, stretches of identical sequences shared between differing target sequences can be identified ranging from about two to about fourteen nucleotides in length. These identical regions can be designed into extended siNA helixes (e.g., >30 base pairs) such that the processing by Dicer reveals a secondary functional 5'-antisense site (see for example FIG. 25). For example, when the first 17 nucleotides of a siNA antisense strand (e.g., 21 nucleotide strands in a duplex with 3'-TT overhangs) are complementary to a target RNA, robust silencing was observed at 25 nM. 80% silencing was observed with only 16 nucleotide complementarity in the same format.

Incorporation of this property into the designs of siNAs of about 30 to 40 or more base pairs results in additional multifunctional siNA constructs. The example in FIG. 25 illustrates how a 30 base-pair duplex can target three distinct sequences after processing by Dicer-RNaseIII; these sequences can be on the same mRNA or separate RNAs, such as viral and host factor messages, or multiple points along a given pathway (e.g., inflammatory cascades). Furthermore, a 40 base-pair duplex can combine a bifunctional design in tandem, to provide a single duplex targeting four target sequences. An even more extensive approach can include use of homologous sequences to enable five or six targets silenced for one multifunctional duplex. The example in FIG. 25 demonstrates how this can be achieved. A 30 base pair duplex is cleaved by Dicer into 22 and 8 base pair products from either end (8 b.p. fragments not shown). For ease of presentation the overhangs generated by dicer are not shown—but can be compensated for. Three targeting sequences are shown. The required sequence identity overlapped is indicated by grey boxes. The N's of the parent 30 b.p. siNA are suggested sites of 2'-OH positions to enable Dicer cleavage if this is tested in stabilized chemistries. Note that processing of a 30mer duplex by Dicer RNase III does not give a precise 22+8 cleavage, but rather produces a series of closely related products (with 22+8 being the primary site). Therefore, processing by Dicer will yield a series of active siNAs. Another non-limiting example is shown in FIG. 26. A 40 base pair duplex is cleaved by Dicer into 20 base pair products from either end. For ease of presentation the overhangs generated by dicer are not shown—but can be compensated for. Four targeting sequences are shown in four colors, blue, light-blue and red and orange. The required sequence identity overlapped is indicated by grey boxes. This design format can be extended to larger RNAs. If chemically stabilized siNAs are bound by Dicer, then strategically located ribonucleotide linkages can enable designer cleavage products that permit our more extensive repertoire of multifunctional designs. For example cleavage products not limited to the Dicer standard of approximately 22-nucleotides can allow multifunctional siNA constructs with a target sequence identity overlap ranging from, for example, about 3 to about 15 nucleotides.

Example 12

Diagnostic Uses

The siNA molecules of the invention can be used in a variety of diagnostic applications, such as in the identification of molecular targets (e.g., RNA) in a variety of applications, for example, in clinical, industrial, environmental, agricultural and/or research settings. Such diagnostic use of siNA molecules involves utilizing reconstituted RNAi systems, for example, using cellular lysates or partially purified cellular lysates. siNA molecules of this invention can be used as diagnostic tools to examine genetic drift and mutations within diseased cells or to detect the presence of endogenous or exogenous, for example viral, RNA in a cell. The close relationship between siNA activity and the structure of the target RNA allows the detection of mutations in any region of the molecule, which alters the base-pairing and three-dimensional structure of the target RNA. By using multiple siNA molecules described in this invention, one can map nucleotide changes, which are important to RNA structure and function in vitro, as well as in cells and tissues. Cleavage of target RNAs with siNA molecules can be used to inhibit gene expression and define the role of specified gene products in the progression of disease or infection. In this manner, other genetic targets can be defined as important mediators of the disease. These experiments will lead to better treatment of the disease progression by affording the possibility of combination therapies (e.g., multiple siNA molecules targeted to different genes, siNA molecules coupled with known small molecule inhibitors, or intermittent treatment with combinations siNA molecules and/or other chemical or biological molecules). Other in vitro uses of siNA molecules of this invention are well known in the art, and include detection of the presence of mRNAs associated with a disease, infection, or related condition. Such RNA is detected by determining the presence of a cleavage product after treatment with a siNA using standard methodologies, for example, fluorescence resonance emission transfer (FRET).

In a specific example, siNA molecules that cleave only wild-type or mutant forms of the target RNA are used for the assay. The first siNA molecules (i.e., those that cleave only wild-type forms of target RNA) are used to identify wild-type RNA present in the sample and the second siNA molecules (i.e., those that cleave only mutant forms of target RNA) are used to identify mutant RNA in the sample. As reaction controls, synthetic substrates of both wild-type and mutant RNA are cleaved by both siNA molecules to demonstrate the relative siNA efficiencies in the reactions and the absence of cleavage of the "non-targeted" RNA species. The cleavage products from the synthetic substrates also serve to generate size markers for the analysis of wild-type and mutant RNAs in the sample population. Thus, each analysis requires two siNA molecules, two substrates and one unknown sample, which is combined into six reactions. The presence of cleavage products is determined using an RNase protection assay so that full-length and cleavage fragments of each RNA can be analyzed in one lane of a polyacrylamide gel. It is not absolutely required to quantify the results to gain insight into the expression of mutant RNAs and putative risk of the desired phenotypic changes in target cells. The expression of mRNA whose protein product is implicated in the development of the phenotype (i.e., disease related or infection related) is adequate to establish risk. If probes of comparable specific activity are used for both transcripts, then a qualitative comparison of RNA levels is adequate and decreases the cost of the initial diagnosis. Higher mutant form to wild-type ratios are correlated with higher risk whether RNA levels are compared qualitatively or quantitatively.

All patents and publications mentioned in the specification are indicative of the levels of skill of those skilled in the art to which the invention pertains. All references cited in this disclosure are incorporated by reference to the same extent as if each reference had been incorporated by reference in its entirety individually.

One skilled in the art would readily appreciate that the present invention is well adapted to carry out the objects and obtain the ends and advantages mentioned, as well as those inherent therein. The methods and compositions described herein as presently representative of preferred embodiments are exemplary and are not intended as limitations on the scope of the invention. Changes therein and other uses will occur to those skilled in the art, which are encompassed within the spirit of the invention, are defined by the scope of the claims.

It will be readily apparent to one skilled in the art that varying substitutions and modifications can be made to the invention disclosed herein without departing from the scope and spirit of the invention. Thus, such additional embodiments are within the scope of the present invention and the following claims. The present invention teaches one skilled in the art to test various combinations and/or substitutions of chemical modifications described herein toward generating nucleic acid constructs with improved activity for mediating RNAi activity. Such improved activity can comprise improved stability, improved bioavailability, and/or improved activation of cellular responses mediating RNAi. Therefore, the specific embodiments described herein are not limiting and one skilled in the art can readily appreciate that specific combinations of the modifications described herein can be tested without undue experimentation toward identifying siNA molecules with improved RNAi activity.

The invention illustratively described herein suitably can be practiced in the absence of any element or elements, limitation or limitations that are not specifically disclosed herein. The terms and expressions which have been employed are used as terms of description and not of limitation, and there is no intention that in the use of such terms and expressions of excluding any equivalents of the features shown and described or portions thereof, but it is recognized that various modifications are possible within the scope of the invention claimed. Thus, it should be understood that although the present invention has been specifically disclosed by preferred embodiments, optional features, modification and variation of the concepts herein disclosed may be resorted to by those skilled in the art, and that such modifications and variations are considered to be within the scope of this invention as defined by the description and the appended claims.

In addition, where features or aspects of the invention are described in terms of Markush groups or other grouping of alternatives, those skilled in the art will recognize that the invention is also thereby described in terms of any individual member or subgroup of members of the Markush group or other group.

TABLE I

RSV Accession Numbers

1: AF035006
Human respiratory syncytial virus, recombinant mutant rA2cp, complete genome
gi|3089371|gb|AF035006.1|[3089371]
2: U50362
Human respiratory syncytial virus, mutant cp-RSV, complete genome
gi|2627296|gb|U50362.1|HRU50362[2627296]
3: U50363
Human respiratory syncytial virus, mutant cpts-248, complete genome
gi|2627309|gb|U50363.1|HRU50363[2627309]
4: U63644
Human respiratory syncytial virus, mutant cpts-248/404, complete genome
gi|1695254|gb|U63644.1|HRU63644[1695254]
5: M74568
Human respiratory syncytial virus nonstructural protein 1, nonstructural protein 2, nucleocapsid protein, phosphoprotein, matrix protein, small hydrophobic protein, glycoprotein, fusion glycoprotein, 22K/M2 protein and L protein mRNA, complete cds
gi|333959|gb|M74568.1|RSHSEQ[333959]
6: AY911262
Human respiratory syncytial virus strain ATCC VR-26, complete genome
gi|60549163|gb|AY911262.1|[60549163]
7: U39662
Human respiratory syncytial virus, complete genome
gi|1912287|gb|U39662.1|HRU39662[1912287]
8: U39661
Respiratory syncytial virus, complete genome
gi|1912298|gb|U39661.1|RSU39661[1912298]
9: M11486
Human respiratory syncytial virus nonstructural protein (1C), nonstructural protein (1B), major nucleocapsid (N), phosphoprotein (P), TABLE I-continued RSV Accession Numbers protein (M), 1A (1A), G (G), protein (F) and envelope-associated
protein (22K) gene, complete cds
gi|333925|gb|M11486.1|RSH1CE[333925]
10: M75730
Human respiratory syncytial virus polymerase L RNA, complete cds
gi|333955|gb|M75730.1|RSHPOLLA[333955]
11: U27298
Human respiratory syncytial virus RNA-dependent RNA polymerase (L)
gene, complete cds
gi|1143829|gb|U27298.1|HRU27298[1143829]
12: AF254574
Human respiratory syncytial virus M2 gene, partial sequence; and
polymerase L gene, complete cds
gi|7960297|gb|AF254574.1|AF254574[7960297]
13: U35343
Human respiratory syncytial virus RNA polymerase large subunit (L)
gene, complete cds
gi|1016280|gb|U35343.1|HRU35343[1016280]
14: D00151
Human respiratory syncytial virus genes for fusion protein and 22K
protein, complete cds
gi|222548|dbj|D00151.1|RSH22K[222548]
15: X02221
Human respiratory syncytial virus (A2) mRNA for fusion glycoprotein Fo
gi|61210|emb|X02221.1|PNRSF0[61210]
16: M22643
Human respiratory syncytial virus fusion (F) protein mRNA, complete cds
gi|333938|gb|M22643.1|RSHF1[333938]
17: AY330616
Human respiratory syncytial virus strain Long fusion protein precursor,
gene, complete cds
gi|37674753|gb|AY330616.1|[37674753]
18: AY330613
Human respiratory syncytial virus strain Long clone T1480G fusion
protein precursor, gene, complete cds
gi|37674747|gb|AY330613.1|[37674747]
19: AY330614
Human respiratory syncytial virus strain Long clone T433A fusion
protein precursor, gene, complete cds
gi|37674749|gb|AY330614.1|[37674749]
20: AY330615
Human respiratory syncytial virus strain Long clone T444C fusion
protein precursor, gene, complete cds
gi|37674751|gb|AY330615.1|[37674751]
21: AY330611
Human respiratory syncytial virus strain Long clone A1188G fusion
protein precursor, gene, complete cds
gi|37674743|gb|AY330611.1|[37674743]
22: AY330612
Human respiratory syncytial virus strain Long clone A1194G fusion
protein precursor, gene, complete cds
gi|37674745|gb|AY330612.1|[37674745]
23: Z26524
Human respiratory syncytial virus F gene for fusion protein
gi|403378|emb|Z26524.1|HRSVFG[403378]
24: L25351
Human respiratory syncytial virus fusion protein (F) mRNA, complete cds
gi|409060|gb|L25351.1|RSHFUSP[409060]
25: AY198176
Human respiratory syncytial virus strain E49 fusion protein gene,
complete cds
gi|29290040|gb|AY198176.1|[29290040]
26: U31559
Human respiratory syncytial virus, strain RSB89-5857, fusion protein
(F) mRNA, complete cds
gi|961608|gb|U31559.1|HRU31559[961608]
27: U31560
Human respiratory syncytial virus, strain RSB89-1734, fusion protein
(F) mRNA, complete cds
gi|961610|gb|U31560.1|HRU31560[961610]
28: U31558
Human respiratory syncytial virus, strain RSB89-6190, fusion protein
(F) mRNA, complete cds
gi|961606|gb|U31558.1|HRU31558[961606]
29: U31562
Human respiratory syncytial virus, strain RSB89-6614, fusion protein
(F) mRNA, complete cds
gi|961614|gb|U31562.1|HRU31562[961614]

30: AY526556
Human respiratory syncytial virus isolate SAA1SA98D707 fusion protein
gene, partial cds
gi|46405973|gb|AY526556.1|[46405973]
31: AY526553
Human respiratory syncytial virus isolate GA5SA97D1131 fusion protein
gene, partial cds
gi|46405967|gb|AY526553.1|[46405967]
32: AF067125
Human respiratory syncytial virus fusion protein (F) mRNA, partial cds
gi|3172521|gb|AF067125.1|AF067125[3172521]
33: X00001
Human respiratory syncytial (RS) virus nucleocapsid gene
gi|61215|emb|X00001.1|PNRSO1[61215]
34: X03149
Respiratory syncytial virus mRNA for envelope glycoprotein G
gi|60997|emb|X03149.1|PARSENVG[60997]
35: M22644
Human respiratory syncytial virus phosphoprotein (P) mRNA,
complete cds
gi|333949|gb|M22644.1|RSHP1[333949]
36: AF065405
Human respiratory syncytial virus strain WV2780 attachment glycoprotein
G mRNA, complete cds
gi|4106742|gb|AF065405.1|AF065405[4106742]
37: M17212
Human respiratory syncytial virus (subgroup A) attachment protein (G)
mRNA, complete cds
gi|333940|gb|M17212.1|RSHGLYG[333940]
38: M29342
Human respiratory syncytial virus phosphoprotein mRNA, complete cds
gi|333951|gb|M29342.1|RSHPHOS[333951]
39: AF065407
Human respiratory syncytial virus strain WV6973 attachment glycoprotein
G mRNA, partial cds
gi|4106746|gb|AF065407.1|AF065407[4106746]
40: AY151197
Human respiratory syncytial virus isolate sa97D1131 nucleoprotein (N)
mRNA, partial cds
gi|32140842|gb|AY151197.1|[32140842]
41: AY151194
Human respiratory syncytial virus isolate SA98V173 nucleoprotein (N)
mRNA, partial cds
gi|32140836|gb|AY151194.1|[32140836]
42: AY151196
Human respiratory syncytial virus isolate sa97D540 nucleoprotein (N)
mRNA, partial cds
gi|32140840|gb|AY151196.1|[32140840]
43: AY151198
Human respiratory syncytial virus isolate Ab3061CT01 nucleoprotein (N)
mRNA, partial cds
gi|32140844|gb|AY151198.1|[32140844]
44: AY151199
Human respiratory syncytial virus isolate Ab4029B101 nucleoprotein (N)
mRNA, partial cds
gi|32140846|gb|AY151199.1|[32140846]
45: AY151195
Human respiratory syncytial virus isolate SA98d707 nucleoprotein (N)
mRNA, partial cds
gi|32140838|gb|AY151195.1|[32140838]
46: AM040047
Human respiratory syncytial virus partial fusion protein gene for
fusion protein, genomic RNA
gi|68161825|emb|AM040047.1|[68161825]
47: U35030
Respiratory syncytial virus nonstructural protein 1 mRNA, partial cds
gi|1016239|gb|U35030.1|RSU35030[1016239]
48: U35029
Respiratory syncytial virus nonstructural protein 2 mRNA, complete cds
gi|1016237|gb|U35029.1|RSU35029[1016237]
49: M17245
Human respiratory syncytial virus (RS) polymerase L gene, 5' end, and
22K protein gene, 3' end
gi|333953|gb|M17245.1|RSHPOLL[333953]
50: S70183
glycoprotein G = secreted form {alternative initiation} [respiratory
syncytial virus, mRNA Partial, 240 nt]
gi|547067|bbm|339653|bbs|148059|gb|S70183.1|[547067]

TABLE I-continued

RSV Accession Numbers

51: AJ492167
respiratory syncytial virus partial N gene for nucleoprotein, genomic RNA, isolate CT343/00
gi|32329733|emb|AJ492167.1|RSY492167[32329733]
52: AJ492163
respiratory syncytial virus partial N gene for nucleoprotein, genomic RNA, isolate CT243/00
gi|32329725|emb|AJ492163.1|RSY492163[32329725]
53: AJ492159
respiratory syncytial virus partial N gene for nucleoprotein, genomic RNA, isolate CT127/00
gi|32329717|emb|AJ492159.1|RSY492159[32329717]
54: AF280466
Respiratory syncytial virus isolate A SH protein (SH) gene, complete cds
gi|11055422|gb|AF280466.1|AF280466[11055422]
55: AJ492166
respiratory syncytial virus partial N gene for nucleoprotein, genomic RNA, isolate CT328/00
gi|32329731|emb|AJ492166.1|RSY492166[32329731]
56: AJ492155
respiratory syncytial virus partial N gene for nucleoprotein, genomic RNA, isolate CT107A/00
gi|32329709|emb|AJ492155.1|RSY492155[32329709]
57: AJ492165
respiratory syncytial virus partial N gene for nucleoprotein, genomic RNA, isolate CT287/00
gi|32329729|emb|AJ492165.1|RSY492165[32329729]
58: AJ492158
respiratory syncytial virus partial N gene for nucleoprotein, genomic RNA, isolate CT122/00
gi|32329715|emb|AJ492158.1|RSY492158[32329715]
59: AF280490
Respiratory syncytial virus isolate 181P2 SH protein (SH) gene, complete cds
gi|11055470|gb|AF280490.1|AF280490[11055470]
60: AF280469
Respiratory syncytial virus isolate 022 SH protein (SH) gene, complete cds
gi|11055428|gb|AF280469.1|AF280469[11055428]
61: AF280482
Respiratory syncytial virus isolate 136 SH protein (SH) gene, complete cds
gi|11055454|gb|AF280482.1|AF280482[11055454]
62: AF280487
Respiratory syncytial virus isolate 159P2 SH protein (SH) gene, complete cds
gi|11055464|gb|AF280487.1|AF280487[11055464]
63: AF280483
Respiratory syncytial virus isolate 139P2 SH protein (SH) gene, complete cds
gi|11055456|gb|AF280483.1|AF280483[11055456]
64: AF280492
Respiratory syncytial virus isolate 194 SH protein (SH) gene, complete cds
gi|11055474|gb|AF280492.1|AF280492[11055474]
65: AF280471
Respiratory syncytial virus isolate 037A SH protein (SH) gene, complete cds
gi|11055432|gb|AF280471.1|AF280471[11055432]
66: AF280488
Respiratory syncytial virus isolate 160 SH protein (SH) gene, complete cds
gi|11055466|gb|AF280488.1|AF280488[11055466]
67: AF280476
Respiratory syncytial virus isolate 081P2 SH protein (SH) gene, complete cds
gi|11055442|gb|AF280476.1|AF280476[11055442]
68: AJ492164
respiratory syncytial virus partial N gene for nucleoprotein, genomic RNA, isolate CT25/00
gi|32329727|emb|AJ492164.1|RSY492164[32329727]
69: AF280475
Respiratory syncytial virus isolate 073 SH protein (SH) gene, complete cds
gi|11055440|gb|AF280475.1|AF280475[11055440]
70: AF280467
Respiratory syncytial virus isolate 013A SH protein (SH) gene, complete cds
gi|11055424|gb|AF280467.1|AF280467[11055424]
71: AF280484
Respiratory syncytial virus isolate 143BCE SH protein (SH) gene, complete cds
gi|11055458|gb|AF280484.1|AF280484[11055458]
72: AF280468
Respiratory syncytial virus isolate 021C SH protein (SH) gene, complete cds
gi|11055426|gb|AF280468.1|AF280468[11055426]
73: AF280485
Respiratory syncytial virus isolate 151P2 SH protein (SH) gene, complete cds
gi|110554460|gb|AF280485.1|AF280485[11055460]
74: AF280481
Respiratory syncytial virus isolate 132S SH protein (SH) gene, complete cds
gi|11055452|gb|AF280481.1|AF280481[11055452]
75: AF280477
Respiratory syncytial virus isolate 084P1 SH protein (SH) gene, complete cds
gi|11055444|gb|AF280477.1|AF280477[11055444]
76: AF280473
Respiratory syncytial virus isolate 050 SH protein (SH) gene, complete cds
gi|11055436|gb|AF280473.1|AF280473[11055436]
77: AF280486
Respiratory syncytial virus isolate 154 SH protein (SH) gene, complete cds
gi|11055462|gb|AF280486.1|AF280486[11055462]
78: AF280478
Respiratory syncytial virus isolate 091 SH protein (SH) gene, complete cds
gi|11055446|gb|AF280478.1|AF280478[11055446]
79: AF280491
Respiratory syncytial virus isolate 191 SH protein (SH) gene, complete cds
gi|11055472|gb|AF280491.1|AF280491[11055472]
80: AF280470
Respiratory syncytial virus isolate 026A SH protein (SH) gene, complete cds
gi|1055430|gb|AF280470.1|AF280470[11055430]
81: AF280480
Respiratory syncytial virus isolate 117 SH protein (SH) gene, complete cds
gi|11055450|gb|AF280480.1|AF280480[11055450]
82: AF280472
Respiratory syncytial virus isolate 044 SH protein (SH) gene, complete cds
gi|11055434|gb|AF280472.1|AF280472[11055434]
83: AF280489
Respiratory syncytial virus isolate 173P3 SH protein (SH) gene, complete cds
gi|11055468|gb|AF280489.1|AF280489[11055468]
84: AJ492162
respiratory syncytial virus partial N gene for nucleoprotein, genomic RNA, isolate CT20/00
gi|32329723|emb|AJ492162.1|RSY492162[32329723]

TABLE II

RSV siNA AND TARGET SEQUENCES

| Pos | Seq | Seq ID | UPos | Upper seq | Seq ID | LPos | Lower seq | Seq ID |
|---|---|---|---|---|---|---|---|---|
| 38 | AAAAAAUGGGGCAAAUAAG | 1 | 38 | AAAAAAUGGGGCAAAUAAG | 1 | 56 | CUUAUUUGCCCCAUUUUUU | 1268 |
| 39 | AAAAAUGGGGCAAAUAAGA | 2 | 39 | AAAAAUGGGGCAAAUAAGA | 2 | 57 | UCUUAUUUGCCCCAUUUUU | 1269 |
| 40 | AAAAUGGGGCAAAUAAGAA | 3 | 40 | AAAAUGGGGCAAAUAAGAA | 3 | 58 | UUCUUAUUUGCCCCAUUUU | 1270 |
| 41 | AAAUGGGGCAAAUAAGAAU | 4 | 41 | AAAUGGGGCAAAUAAGAAU | 4 | 59 | AUUCUUAUUUGCCCCAUUU | 1271 |
| 42 | AAUGGGGCAAAUAAGAAUU | 5 | 42 | AAUGGGGCAAAUAAGAAUU | 5 | 60 | AAUUCUUAUUUGCCCCAUU | 1272 |
| 43 | AUGGGGCAAAUAAGAAUUU | 6 | 43 | AUGGGGCAAAUAAGAAUUU | 6 | 61 | AAAUUCUUAUUUGCCCCAU | 1273 |
| 44 | UGGGGCAAAUAAGAAUUUG | 7 | 44 | UGGGGCAAAUAAGAAUUUG | 7 | 62 | CAAAUUCUUAUUUGCCCCA | 1274 |
| 45 | GGGGCAAAUAAGAAUUUGA | 8 | 45 | GGGGCAAAUAAGAAUUUGA | 8 | 63 | UCAAAUUCUUAUUUGCCCC | 1275 |
| 46 | GGGCAAAUAAGAAUUUGAU | 9 | 46 | GGGCAAAUAAGAAUUUGAU | 9 | 64 | AUCAAAUUCUUAUUUGCCC | 1276 |
| 47 | GGCAAAUAAGAAUUUGAUA | 10 | 47 | GGCAAAUAAGAAUUUGAUA | 10 | 65 | UAUCAAAUUCUUAUUUGCC | 1277 |
| 48 | GCAAAUAAGAAUUUGAUAA | 11 | 48 | GCAAAUAAGAAUUUGAUAA | 11 | 66 | UUAUCAAAUUCUUAUUUGC | 1278 |
| 49 | CAAAUAAGAAUUUGAUAAG | 12 | 49 | CAAAUAAGAAUUUGAUAAG | 12 | 67 | CUUAUCAAAUUCUUAUUUG | 1279 |
| 50 | AAAUAAGAAUUUGAUAAGU | 13 | 50 | AAAUAAGAAUUUGAUAAGU | 13 | 68 | ACUUAUCAAAUUCUUAUUU | 1280 |
| 159 | GAAGUAGCAUUGUUAAAAA | 14 | 159 | GAAGUAGCAUUGUUAAAAA | 14 | 177 | UUUUUAACAAUGCUACUUC | 1281 |
| 160 | AAGUAGCAUUGUUAAAAAU | 15 | 160 | AAGUAGCAUUGUUAAAAAU | 15 | 178 | AUUUUUAACAAUGCUACUU | 1282 |
| 161 | AGUAGCAUUGUUAAAAAUA | 16 | 161 | AGUAGCAUUGUUAAAAAUA | 16 | 179 | UAUUUUUAACAAUGCUACU | 1283 |
| 162 | GUAGCAUUGUUAAAAAUAA | 17 | 162 | GUAGCAUUGUUAAAAAUAA | 17 | 180 | UUAUUUUUAACAAUGCUAC | 1284 |
| 163 | UAGCAUUGUUAAAAAUAAC | 18 | 163 | UAGCAUUGUUAAAAAUAAC | 18 | 181 | GUUAUUUUUAACAAUGCUA | 1285 |
| 164 | AGCAUUGUUAAAAAUAACA | 19 | 164 | AGCAUUGUUAAAAAUAACA | 19 | 182 | UGUUAUUUUUAACAAUGCU | 1286 |
| 165 | GCAUUGUUAAAAAUAACAU | 20 | 165 | GCAUUGUUAAAAAUAACAU | 20 | 183 | AUGUUAUUUUUAACAAUGC | 1287 |
| 166 | CAUUGUUAAAAAUAACAUG | 21 | 166 | CAUUGUUAAAAAUAACAUG | 21 | 184 | CAUGUUAUUUUUAACAAUG | 1288 |
| 775 | AGAAAACUUGAUGAAAGAC | 22 | 775 | AGAAAACUUGAUGAAAGAC | 22 | 793 | GUCUUUCAUCAAGUUUUCU | 1289 |
| 776 | GAAAACUUGAUGAAAGACA | 23 | 776 | GAAAACUUGAUGAAAGACA | 23 | 794 | UGUCUUUCAUCAAGUUUUC | 1290 |
| 943 | AUUGGCAUUAAGCCUACAA | 24 | 943 | AUUGGCAUUAAGCCUACAA | 24 | 961 | UUGUAGGCUUAAUGCCAAU | 1291 |
| 944 | UUGGCAUUAAGCCUACAAA | 25 | 944 | UUGGCAUUAAGCCUACAAA | 25 | 962 | UUUGUAGGCUUAAUGCCAA | 1292 |
| 1140 | AUGGCUCUUAGCAAAGUCA | 26 | 1140 | AUGGCUCUUAGCAAAGUCA | 26 | 1158 | UGACUUUGCUAAGAGCCAU | 1293 |
| 1141 | UGGCUCUUAGCAAAGUCAA | 27 | 1141 | UGGCUCUUAGCAAAGUCAA | 27 | 1159 | UUGACUUUGCUAAGAGCCA | 1294 |
| 1142 | GGCUCUUAGCAAAGUCAAG | 28 | 1142 | GGCUCUUAGCAAAGUCAAG | 28 | 1160 | CUUGACUUUGCUAAGAGCC | 1295 |
| 1143 | GCUCUUAGCAAAGUCAAGU | 29 | 1143 | GCUCUUAGCAAAGUCAAGU | 29 | 1161 | ACUUGACUUUGCUAAGAGC | 1296 |
| 1144 | CUCUUAGCAAAGUCAAGUU | 30 | 1144 | CUCUUAGCAAAGUCAAGUU | 30 | 1162 | AACUUGACUUUGCUAAGAG | 1297 |
| 1329 | UUAAUAGGUAUGUUAUAUG | 31 | 1329 | UUAAUAGGUAUGUUAUAUG | 31 | 1347 | CAUAUAACAUACCUAUUAA | 1298 |
| 1330 | UAAUAGGUAUGUUAUAUGC | 32 | 1330 | UAAUAGGUAUGUUAUAUGC | 32 | 1348 | GCAUAUAACAUACCUAUUA | 1299 |
| 1518 | AUUGAGAUAGAAUCUAGAA | 33 | 1518 | AUUGAGAUAGAAUCUAGAA | 33 | 1536 | UUCUAGAUUCUAUCUCAAU | 1300 |
| 1519 | UUGAGAUAGAAUCUAGAAA | 34 | 1519 | UUGAGAUAGAAUCUAGAAA | 34 | 1537 | UUUCUAGAUUCUAUCUCAA | 1301 |
| 1539 | UCCUACAAAAAAUGCUAA | 35 | 1539 | UCCUACAAAAAAUGCUAA | 35 | 1557 | UUAGCAUUUUUUGUAGGA | 1302 |
| 1540 | CCUACAAAAAAUGCUAAA | 36 | 1540 | CCUACAAAAAAUGCUAAA | 36 | 1558 | UUUAGCAUUUUUUGUAGG | 1303 |
| 1541 | CUACAAAAAAUGCUAAAA | 37 | 1541 | CUACAAAAAAUGCUAAAA | 37 | 1559 | UUUUAGCAUUUUUUGUAG | 1304 |
| 1542 | UACAAAAAAUGCUAAAAG | 38 | 1542 | UACAAAAAAUGCUAAAAG | 38 | 1560 | CUUUUAGCAUUUUUUGUA | 1305 |

TABLE II-continued

RSV siNA AND TARGET SEQUENCES

| Pos | Seq | Seq ID | UPos | Upper seq | Seq ID | LPos | Lower seq | Seq ID |
|---|---|---|---|---|---|---|---|---|
| 1543 | ACAAAAAAAUGCUAAAAGA | 39 | 1543 | ACAAAAAAAUGCUAAAAGA | 39 | 1561 | UCUUUUAGCAUUUUUUGU | 1306 |
| 2037 | UUCUACCAUAUAUUGAACA | 40 | 2037 | UUCUACCAUAUAUUGAACA | 40 | 2055 | UGUUCAAUAUAUGGUAGAA | 1307 |
| 2038 | UCUACCAUAUAUUGAACAA | 41 | 2038 | UCUACCAUAUAUUGAACAA | 41 | 2056 | UUGUUCAAUAUAUGGUAGA | 1308 |
| 2402 | AAAUUCCUAGAAUCAAUAA | 42 | 2402 | AAAUUCCUAGAAUCAAUAA | 42 | 2420 | UUAUUGAUUCUAGGAAUUU | 1309 |
| 2403 | AAUUCCUAGAAUCAAUAAA | 43 | 2403 | AAUUCCUAGAAUCAAUAAA | 43 | 2421 | UUUAUUGAUUCUAGGAAUU | 1310 |
| 2404 | AUUCCUAGAAUCAAUAAAG | 44 | 2404 | AUUCCUAGAAUCAAUAAAG | 44 | 2422 | CUUUAUUGAUUCUAGGAAU | 1311 |
| 2405 | UUCCUAGAAUCAAUAAAGG | 45 | 2405 | UUCCUAGAAUCAAUAAAGG | 45 | 2423 | CCUUUAUUGAUUCUAGGAA | 1312 |
| 2406 | UCCUAGAAUCAAUAAAGGG | 46 | 2406 | UCCUAGAAUCAAUAAAGGG | 46 | 2424 | CCCUUUAUUGAUUCUAGGA | 1313 |
| 2407 | CCUAGAAUCAAUAAAGGGC | 47 | 2407 | CCUAGAAUCAAUAAAGGGC | 47 | 2425 | GCCCUUUAUUGAUUCUAGG | 1314 |
| 2408 | CUAGAAUCAAUAAAGGGCA | 48 | 2408 | CUAGAAUCAAUAAAGGGCA | 48 | 2426 | UGCCCUUUAUUGAUUCUAG | 1315 |
| 2409 | UAGAAUCAAUAAAGGGCAA | 49 | 2409 | UAGAAUCAAUAAAGGGCAA | 49 | 2427 | UUGCCCUUUAUUGAUUCUA | 1316 |
| 2477 | AACUCAAUAGAUAUAGAAG | 50 | 2477 | AACUCAAUAGAUAUAGAAG | 50 | 2495 | CUUCUAUAUCUAUUGAGUU | 1317 |
| 2478 | ACUCAAUAGAUAUAGAAGU | 51 | 2478 | ACUCAAUAGAUAUAGAAGU | 51 | 2496 | ACUUCUAUAUCUAUUGAGU | 1318 |
| 2479 | CUCAAUAGAUAUAGAAGUA | 52 | 2479 | CUCAAUAGAUAUAGAAGUA | 52 | 2497 | UACUUCUAUAUCUAUUGAG | 1319 |
| 2480 | UCAAUAGAUAUAGAAGUAA | 53 | 2480 | UCAAUAGAUAUAGAAGUAA | 53 | 2498 | UUACUUCUAUAUCUAUUGA | 1320 |
| 2481 | CAAUAGAUAUAGAAGUAAC | 54 | 2481 | CAAUAGAUAUAGAAGUAAC | 54 | 2499 | GUUACUUCUAUAUCUAUUG | 1321 |
| 2669 | ACAUUUGAUAACAAUGAAG | 55 | 2669 | ACAUUUGAUAACAAUGAAG | 55 | 2687 | CUUCAUUGUUAUCAAAUGU | 1322 |
| 2670 | CAUUUGAUAACAAUGAAGA | 56 | 2670 | CAUUUGAUAACAAUGAAGA | 56 | 2688 | UCUUCAUUGUUAUCAAAUG | 1323 |
| 2671 | AUUUGAUAACAAUGAAGAA | 57 | 2671 | AUUUGAUAACAAUGAAGAA | 57 | 2689 | UUCUUCAUUGUUAUCAAAU | 1324 |
| 2672 | UUUGAUAACAAUGAAGAAG | 58 | 2672 | UUUGAUAACAAUGAAGAAG | 58 | 2690 | CUUCUUCAUUGUUAUCAAA | 1325 |
| 2673 | UUGAUAACAAUGAAGAAGA | 59 | 2673 | UUGAUAACAAUGAAGAAGA | 59 | 2691 | UCUUCUUCAUUGUUAUCAA | 1326 |
| 2674 | UGAUAACAAUGAAGAAGAA | 60 | 2674 | UGAUAACAAUGAAGAAGAA | 60 | 2692 | UUCUUCUUCAUUGUUAUCA | 1327 |
| 2675 | GAUAACAAUGAAGAAGAAU | 61 | 2675 | GAUAACAAUGAAGAAGAAU | 61 | 2693 | AUUCUUCUUCAUUGUUAUC | 1328 |
| 2676 | AUAACAAUGAAGAAGAAUC | 62 | 2676 | AUAACAAUGAAGAAGAAUC | 62 | 2694 | GAUUCUUCUUCAUUGUUAU | 1329 |
| 2759 | AUUGAUGAAAAUUAAGUG | 63 | 2759 | AUUGAUGAAAAUUAAGUG | 63 | 2777 | CACUUAAUUUUCAUCAAU | 1330 |
| 2760 | UUGAUGAAAAUUAAGUGA | 64 | 2760 | UUGAUGAAAAUUAAGUGA | 64 | 2778 | UCACUUAAUUUUCAUCAA | 1331 |
| 2761 | UGAUGAAAAUUAAGUGAA | 65 | 2761 | UGAUGAAAAUUAAGUGAA | 65 | 2779 | UUCACUUAAUUUUCAUCA | 1332 |
| 2762 | GAUGAAAAUUAAGUGAAA | 66 | 2762 | GAUGAAAAUUAAGUGAAA | 66 | 2780 | UUUCACUUAAUUUUCAUC | 1333 |
| 2763 | AUGAAAAUUAAGUGAAAU | 67 | 2763 | AUGAAAAUUAAGUGAAAU | 67 | 2781 | AUUUCACUUAAUUUUCAU | 1334 |
| 2764 | UGAAAAUUAAGUGAAAUA | 68 | 2764 | UGAAAAUUAAGUGAAAUA | 68 | 2782 | UAUUUCACUUAAUUUUCA | 1335 |
| 2897 | GAAGCAUUAAUGACCAAUG | 69 | 2897 | GAAGCAUUAAUGACCAAUG | 69 | 2915 | CAUUGGUCAUUAAUGCUUC | 1336 |
| 2898 | AAGCAUUAAUGACCAAUGA | 70 | 2898 | AAGCAUUAAUGACCAAUGA | 70 | 2916 | UCAUUGGUCAUUAAUGCUU | 1337 |
| 3223 | UGGGGCAAAUAUGGAAACA | 71 | 3223 | UGGGGCAAAUAUGGAAACA | 71 | 3241 | UGUUUCCAUAUUUGCCCCA | 1338 |
| 3224 | GGGGCAAAUAUGGAAACAU | 72 | 3224 | GGGGCAAAUAUGGAAACAU | 72 | 3242 | AUGUUUCCAUAUUUGCCCC | 1339 |
| 3225 | GGGCAAAUAUGGAAACAUA | 73 | 3225 | GGGCAAAUAUGGAAACAUA | 73 | 3243 | UAUGUUUCCAUAUUUGCCC | 1340 |
| 3226 | GGCAAAUAUGGAAACAUAC | 74 | 3226 | GGCAAAUAUGGAAACAUAC | 74 | 3244 | GUAUGUUUCCAUAUUUGCC | 1341 |
| 3227 | GCAAAUAUGGAAACAUACG | 75 | 3227 | GCAAAUAUGGAAACAUACG | 75 | 3245 | CGUAUGUUUCCAUAUUUGC | 1342 |

TABLE II-continued

RSV siNA AND TARGET SEQUENCES

| Pos | Seq | Seq ID | UPos | Upper seq | Seq ID | LPos | Lower seq | Seq ID |
|---|---|---|---|---|---|---|---|---|
| 3228 | CAAAUAUGGAAACAUACGU | 76 | 3228 | CAAAUAUGGAAACAUACGU | 76 | 3246 | ACGUAUGUUUCCAUAUUUG | 1343 |
| 3229 | AAAUAUGGAAACAUACGUG | 77 | 3229 | AAAUAUGGAAACAUACGUG | 77 | 3247 | CACGUAUGUUUCCAUAUUU | 1344 |
| 3230 | AAUAUGGAAACAUACGUGA | 78 | 3230 | AAUAUGGAAACAUACGUGA | 78 | 3248 | UCACGUAUGUUUCCAUAUU | 1345 |
| 3231 | AUAUGGAAACAUACGUGAA | 79 | 3231 | AUAUGGAAACAUACGUGAA | 79 | 3249 | UUCACGUAUGUUUCCAUAU | 1346 |
| 3232 | UAUGGAAACAUACGUGAAC | 80 | 3232 | UAUGGAAACAUACGUGAAC | 80 | 3250 | GUUCACGUAUGUUUCCAUA | 1347 |
| 3233 | AUGGAAACAUACGUGAACA | 81 | 3233 | AUGGAAACAUACGUGAACA | 81 | 3251 | UGUUCACGUAUGUUUCCAU | 1348 |
| 3234 | UGGAAACAUACGUGAACAA | 82 | 3234 | UGGAAACAUACGUGAACAA | 82 | 3252 | UUGUUCACGUAUGUUUCCA | 1349 |
| 3254 | CUUCACGAAGGCUCCACAU | 83 | 3254 | CUUCACGAAGGCUCCACAU | 83 | 3272 | AUGUGGAGCCUUCGUGAAG | 1350 |
| 3255 | UUCACGAAGGCUCCACAUA | 84 | 3255 | UUCACGAAGGCUCCACAUA | 84 | 3273 | UAUGUGGAGCCUUCGUGAA | 1351 |
| 3256 | UCACGAAGGCUCCACAUAC | 85 | 3256 | UCACGAAGGCUCCACAUAC | 85 | 3274 | GUAUGUGGAGCCUUCGUGA | 1352 |
| 3257 | CACGAAGGCUCCACAUACA | 86 | 3257 | CACGAAGGCUCCACAUACA | 86 | 3275 | UGUAUGUGGAGCCUUCGUG | 1353 |
| 3258 | ACGAAGGCUCCACAUACAC | 87 | 3258 | ACGAAGGCUCCACAUACAC | 87 | 3276 | GUGUAUGUGGAGCCUUCGU | 1354 |
| 3259 | CGAAGGCUCCACAUACACA | 88 | 3259 | CGAAGGCUCCACAUACACA | 88 | 3277 | UGUGUAUGUGGAGCCUUCG | 1355 |
| 3260 | GAAGGCUCCACAUACACAG | 89 | 3260 | GAAGGCUCCACAUACACAG | 89 | 3278 | CUGUGUAUGUGGAGCCUUC | 1356 |
| 3261 | AAGGCUCCACAUACACAGC | 90 | 3261 | AAGGCUCCACAUACACAGC | 90 | 3279 | GCUGUGUAUGUGGAGCCUU | 1357 |
| 6193 | UUAACCAGCAAAGUGUUAG | 91 | 6193 | UUAACCAGCAAAGUGUUAG | 91 | 6211 | CUAACACUUUGCUGGUUAA | 1358 |
| 6194 | UAACCAGCAAAGUGUUAGA | 92 | 6194 | UAACCAGCAAAGUGUUAGA | 92 | 6212 | UCUAACACUUUGCUGGUUA | 1359 |
| 6427 | AUAACAAAUGAUCAGAAAA | 93 | 6427 | AUAACAAAUGAUCAGAAAA | 93 | 6445 | UUUUCUGAUCAUUUGUUAU | 1360 |
| 6428 | UAACAAAUGAUCAGAAAAA | 94 | 6428 | UAACAAAUGAUCAGAAAAA | 94 | 6446 | UUUUUCUGAUCAUUUGUUA | 1361 |
| 6718 | AAUCGAGUAUUUGUGACA | 95 | 6718 | AAUCGAGUAUUUGUGACA | 95 | 6736 | UGUCACAAAUACUCGAUU | 1362 |
| 6719 | AUCGAGUAUUUGUGACAC | 96 | 6719 | AUCGAGUAUUUGUGACAC | 96 | 6737 | GUGUCACAAAUACUCGAU | 1363 |
| 7093 | UUUGAUGCAUCAAUAUCUC | 97 | 7093 | UUUGAUGCAUCAAUAUCUC | 97 | 7111 | GAGAUAUUGAUGCAUCAAA | 1364 |
| 7094 | UUGAUGCAUCAAUAUCUCA | 98 | 7094 | UUGAUGCAUCAAUAUCUCA | 98 | 7112 | UGAGAUAUUGAUGCAUCAA | 1365 |
| 7095 | UGAUGCAUCAAUAUCUCAA | 99 | 7095 | UGAUGCAUCAAUAUCUCAA | 99 | 7113 | UUGAGAUAUUGAUGCAUCA | 1366 |
| 7096 | GAUGCAUCAAUAUCUCAAG | 100 | 7096 | GAUGCAUCAAUAUCUCAAG | 100 | 7114 | CUUGAGAUAUUGAUGCAUC | 1367 |
| 7097 | AUGCAUCAAUAUCUCAAGU | 101 | 7097 | AUGCAUCAAUAUCUCAAGU | 101 | 7115 | ACUUGAGAUAUUGAUGCAU | 1368 |
| 7098 | UGCAUCAAUAUCUCAAGUC | 102 | 7098 | UGCAUCAAUAUCUCAAGUC | 102 | 7116 | GACUUGAGAUAUUGAUGCA | 1369 |
| 7099 | GCAUCAAUAUCUCAAGUCA | 103 | 7099 | GCAUCAAUAUCUCAAGUCA | 103 | 7117 | UGACUUGAGAUAUUGAUGC | 1370 |
| 7100 | CAUCAAUAUCUCAAGUCAA | 104 | 7100 | CAUCAAUAUCUCAAGUCAA | 104 | 7118 | UUGACUUGAGAUAUUGAUG | 1371 |
| 7802 | UAGUUGGAGUGCUAGAGAG | 105 | 7802 | UAGUUGGAGUGCUAGAGAG | 105 | 7820 | CUCUCUAGCACUCCAACUA | 1372 |
| 7803 | AGUUGGAGUGCUAGAGAGU | 106 | 7803 | AGUUGGAGUGCUAGAGAGU | 106 | 7821 | ACUCUCUAGCACUCCAACU | 1373 |
| 7804 | GUUGGAGUGCUAGAGAGUU | 107 | 7804 | GUUGGAGUGCUAGAGAGUU | 107 | 7822 | AACUCUCUAGCACUCCAAC | 1374 |
| 7805 | UUGGAGUGCUAGAGAGUUA | 108 | 7805 | UUGGAGUGCUAGAGAGUUA | 108 | 7823 | UAACUCUCUAGCACUCCAA | 1375 |
| 7849 | AAACAAUCAGCAUGUGUUG | 109 | 7849 | AAACAAUCAGCAUGUGUUG | 109 | 7867 | CAACACAUGCUGAUUGUUU | 1376 |
| 7850 | AACAAUCAGCAUGUGUUGC | 110 | 7850 | AACAAUCAGCAUGUGUUGC | 110 | 7868 | GCAACACAUGCUGAUUGUU | 1377 |
| 7945 | AAGAUAAGAGUGUACAAUA | 111 | 7945 | AAGAUAAGAGUGUACAAUA | 111 | 7963 | UAUUGUACACUCUUAUCUU | 1378 |
| 7946 | AGAUAAGAGUGUACAAUAC | 112 | 7946 | AGAUAAGAGUGUACAAUAC | 112 | 7964 | GUAUUGUACACUCUUAUCU | 1379 |
| 7947 | GAUAAGAGUGUACAAUACU | 113 | 7947 | GAUAAGAGUGUACAAUACU | 113 | 7965 | AGUAUUGUACACUCUUAUC | 1380 |

TABLE II-continued

RSV siNA AND TARGET SEQUENCES

| Pos | Seq | Seq ID | UPos | Upper seq | Seq ID | LPos | Lower seq | Seq ID |
|---|---|---|---|---|---|---|---|---|
| 7948 | AUAAGAGUGUACAAUACUG | 114 | 7948 | AUAAGAGUGUACAAUACUG | 114 | 7966 | CAGUAUUGUACACUCUUAU | 1381 |
| 7949 | UAAGAGUGUACAAUACUGU | 115 | 7949 | UAAGAGUGUACAAUACUGU | 115 | 7967 | ACAGUAUUGUACACUCUUA | 1382 |
| 8382 | UAUAUAUAUUAGUGUCAUA | 116 | 8382 | UAUAUAUAUUAGUGUCAUA | 116 | 8400 | UAUGACACUAAUAUAUAUA | 1383 |
| 8383 | AUAUAUAUUAGUGUCAUAA | 117 | 8383 | AUAUAUAUUAGUGUCAUAA | 117 | 8401 | UUAUGACACUAAUAUAUAU | 1384 |
| 8459 | UGGGACAAAAUGGAUCCCA | 118 | 8459 | UGGGACAAAAUGGAUCCCA | 118 | 8477 | UGGGAUCCAUUUUGUCCCA | 1385 |
| 8460 | GGGACAAAAUGGAUCCCAU | 119 | 8460 | GGGACAAAAUGGAUCCCAU | 119 | 8478 | AUGGGAUCCAUUUUGUCCC | 1386 |
| 8461 | GGACAAAAUGGAUCCCAUU | 120 | 8461 | GGACAAAAUGGAUCCCAUU | 120 | 8479 | AAUGGGAUCCAUUUUGUCC | 1387 |
| 8462 | GACAAAAUGGAUCCCAUUA | 121 | 8462 | GACAAAAUGGAUCCCAUUA | 121 | 8480 | UAAUGGGAUCCAUUUUGUC | 1388 |
| 8463 | ACAAAAUGGAUCCCAUUAU | 122 | 8463 | ACAAAAUGGAUCCCAUUAU | 122 | 8481 | AUAAUGGGAUCCAUUUUGU | 1389 |
| 8464 | CAAAAUGGAUCCCAUUAUU | 123 | 8464 | CAAAAUGGAUCCCAUUAUU | 123 | 8482 | AAUAAUGGGAUCCAUUUUG | 1390 |
| 8465 | AAAAUGGAUCCCAUUAUUA | 124 | 8465 | AAAAUGGAUCCCAUUAUUA | 124 | 8483 | UAAUAAUGGGAUCCAUUUU | 1391 |
| 8466 | AAAUGGAUCCCAUUAUUAA | 125 | 8466 | AAAUGGAUCCCAUUAUUAA | 125 | 8484 | UUAAUAAUGGGAUCCAUUU | 1392 |
| 8467 | AAUGGAUCCCAUUAUUAAU | 126 | 8467 | AAUGGAUCCCAUUAUUAAU | 126 | 8485 | AUUAAUAAUGGGAUCCAUU | 1393 |
| 8468 | AUGGAUCCCAUUAUUAAUG | 127 | 8468 | AUGGAUCCCAUUAUUAAUG | 127 | 8486 | CAUUAAUAAUGGGAUCCAU | 1394 |
| 8469 | UGGAUCCCAUUAUUAAUGG | 128 | 8469 | UGGAUCCCAUUAUUAAUGG | 128 | 8487 | CCAUUAAUAAUGGGAUCCA | 1395 |
| 8470 | GGAUCCCAUUAUUAAUGGA | 129 | 8470 | GGAUCCCAUUAUUAAUGGA | 129 | 8488 | UCCAUUAAUAAUGGGAUCC | 1396 |
| 8471 | GAUCCCAUUAUUAAUGGAA | 130 | 8471 | GAUCCCAUUAUUAAUGGAA | 130 | 8489 | UUCCAUUAAUAAUGGGAUC | 1397 |
| 8472 | AUCCCAUUAUUAAUGGAAA | 131 | 8472 | AUCCCAUUAUUAAUGGAAA | 131 | 8490 | UUUCCAUUAAUAAUGGGAU | 1398 |
| 8606 | AACUUAAUUAGUAGACAAA | 132 | 8606 | AACUUAAUUAGUAGACAAA | 132 | 8624 | UUUGUCUACUAAUUAAGUU | 1399 |
| 8729 | CAGUCAUUACUUAUGACAU | 133 | 8729 | CAGUCAUUACUUAUGACAU | 133 | 8747 | AUGUCAUAAGUAAUGACUG | 1400 |
| 8730 | AGUCAUUACUUAUGACAUA | 134 | 8730 | AGUCAUUACUUAUGACAUA | 134 | 8748 | UAUGUCAUAAGUAAUGACU | 1401 |
| 9020 | AUCAAAACAACACUCUUGA | 135 | 9020 | AUCAAAACAACACUCUUGA | 135 | 9038 | UCAAGAGUGUUGUUUUGAU | 1402 |
| 9021 | UCAAAACAACACUCUUGAA | 136 | 9021 | UCAAAACAACACUCUUGAA | 136 | 9039 | UUCAAGAGUGUUGUUUUGA | 1403 |
| 9062 | CAUCCUCCAUCAUGGUUAA | 137 | 9062 | CAUCCUCCAUCAUGGUUAA | 137 | 9080 | UUAACCAUGAUGGAGGAUG | 1404 |
| 9063 | AUCCUCCAUCAUGGUUAAU | 138 | 9063 | AUCCUCCAUCAUGGUUAAU | 138 | 9081 | AUUAACCAUGAUGGAGGAU | 1405 |
| 9064 | UCCUCCAUCAUGGUUAAUA | 139 | 9064 | UCCUCCAUCAUGGUUAAUA | 139 | 9082 | UAUUAACCAUGAUGGAGGA | 1406 |
| 9065 | CCUCCAUCAUGGUUAAUAC | 140 | 9065 | CCUCCAUCAUGGUUAAUAC | 140 | 9083 | GUAUUAACCAUGAUGGAGG | 1407 |
| 9066 | CUCCAUCAUGGUUAAUACA | 141 | 9066 | CUCCAUCAUGGUUAAUACA | 141 | 9084 | UGUAUUAACCAUGAUGGAG | 1408 |
| 9347 | ACAUUAAAUAAAAGCUUAG | 142 | 9347 | ACAUUAAAUAAAAGCUUAG | 142 | 9365 | CUAAGCUUUUAUUUAAUGU | 1409 |
| 9348 | CAUUAAAUAAAAGCUUAGG | 143 | 9348 | CAUUAAAUAAAAGCUUAGG | 143 | 9366 | CCUAAGCUUUUAUUUAAUG | 1410 |
| 9470 | GUAGAGGGAUUUAUUAUGU | 144 | 9470 | GUAGAGGGAUUUAUUAUGU | 144 | 9488 | ACAUAAUAAAUCCCUCUAC | 1411 |
| 9471 | UAGAGGGAUUUAUUAUGUC | 145 | 9471 | UAGAGGGAUUUAUUAUGUC | 145 | 9489 | GACAUAAUAAAUCCCUCUA | 1412 |
| 9472 | AGAGGGAUUUAUUAUGUCU | 146 | 9472 | AGAGGGAUUUAUUAUGUCU | 146 | 9490 | AGACAUAAUAAAUCCCUCU | 1413 |
| 9503 | AUAACAGAAGAAGAUCAAU | 147 | 9503 | AUAACAGAAGAAGAUCAAU | 147 | 9521 | AUUGAUCUUCUUCUGUUAU | 1414 |
| 9504 | UAACAGAAGAAGAUCAAUU | 148 | 9504 | UAACAGAAGAAGAUCAAUU | 148 | 9522 | AAUUGAUCUUCUUCUGUUA | 1415 |
| 10047 | UGCCUAAAAAGUGGAUCU | 149 | 10047 | UGCCUAAAAAGUGGAUCU | 149 | 10065 | AGAUCCACUUUUUAGGCA | 1416 |
| 10048 | GCCUAAAAAGUGGAUCUU | 150 | 10048 | GCCUAAAAAGUGGAUCUU | 150 | 10066 | AAGAUCCACUUUUUAGGC | 1417 |

TABLE II-continued

RSV siNA AND TARGET SEQUENCES

| Pos | Seq | Seq ID | UPos | Upper seq | Seq ID | LPos | Lower seq | Seq ID |
|---|---|---|---|---|---|---|---|---|
| 10049 | CCUAAAAAGUGGAUCUUG | 151 | 10049 | CCUAAAAAGUGGAUCUUG | 151 | 10067 | CAAGAUCCACUUUUUAGG | 1418 |
| 10050 | CUAAAAAGUGGAUCUUGA | 152 | 10050 | CUAAAAAGUGGAUCUUGA | 152 | 10068 | UCAAGAUCCACUUUUUAG | 1419 |
| 10051 | UAAAAAGUGGAUCUUGAA | 153 | 10051 | UAAAAAGUGGAUCUUGAA | 153 | 10069 | UUCAAGAUCCACUUUUUA | 1420 |
| 10052 | AAAAAGUGGAUCUUGAAA | 154 | 10052 | AAAAAGUGGAUCUUGAAA | 154 | 10070 | UUUCAAGAUCCACUUUUU | 1421 |
| 10053 | AAAAGUGGAUCUUGAAAU | 155 | 10053 | AAAAGUGGAUCUUGAAAU | 155 | 10071 | AUUUCAAGAUCCACUUUU | 1422 |
| 10054 | AAAGUGGAUCUUGAAAUG | 156 | 10054 | AAAGUGGAUCUUGAAAUG | 156 | 10072 | CAUUUCAAGAUCCACUUU | 1423 |
| 10055 | AAGUGGAUCUUGAAAUGA | 157 | 10055 | AAGUGGAUCUUGAAAUGA | 157 | 10073 | UCAUUUCAAGAUCCACUU | 1424 |
| 10056 | AGUGGAUCUUGAAAUGAU | 158 | 10056 | AGUGGAUCUUGAAAUGAU | 158 | 10074 | AUCAUUUCAAGAUCCACU | 1425 |
| 10334 | CUCAGUGUAGGUAGAAUGU | 159 | 10334 | CUCAGUGUAGGUAGAAUGU | 159 | 10352 | ACAUUCUACCUACACUGAG | 1426 |
| 10335 | UCAGUGUAGGUAGAAUGUU | 160 | 10335 | UCAGUGUAGGUAGAAUGUU | 160 | 10353 | AACAUUCUACCUACACUGA | 1427 |
| 10336 | CAGUGUAGGUAGAAUGUUU | 161 | 10336 | CAGUGUAGGUAGAAUGUUU | 161 | 10354 | AAACAUUCUACCUACACUG | 1428 |
| 10337 | AGUGUAGGUAGAAUGUUUG | 162 | 10337 | AGUGUAGGUAGAAUGUUUG | 162 | 10355 | CAAACAUUCUACCUACACU | 1429 |
| 10338 | GUGUAGGUAGAAUGUUUGC | 163 | 10338 | GUGUAGGUAGAAUGUUUGC | 163 | 10356 | GCAAACAUUCUACCUACAC | 1430 |
| 10445 | ACAAGAUAUGGUGAUCUAG | 164 | 10445 | ACAAGAUAUGGUGAUCUAG | 164 | 10463 | CUAGAUCACCAUAUCUUGU | 1431 |
| 10446 | CAAGAUAUGGUGAUCUAGA | 165 | 10446 | CAAGAUAUGGUGAUCUAGA | 165 | 10464 | UCUAGAUCACCAUAUCUUG | 1432 |
| 10571 | AGCAAAUUCAAUCAAGCAU | 166 | 10571 | AGCAAAUUCAAUCAAGCAU | 166 | 10589 | AUGCUUGAUUGAAUUUGCU | 1433 |
| 10572 | GCAAAUUCAAUCAAGCAUU | 167 | 10572 | GCAAAUUCAAUCAAGCAUU | 167 | 10590 | AAUGCUUGAUUGAAUUUGC | 1434 |
| 10573 | CAAAUUCAAUCAAGCAUUU | 168 | 10573 | CAAAUUCAAUCAAGCAUUU | 168 | 10591 | AAAUGCUUGAUUGAAUUUG | 1435 |
| 10757 | GAUGAACAAAGUGGAUUAU | 169 | 10757 | GAUGAACAAAGUGGAUUAU | 169 | 10775 | AUAAUCCACUUUGUUCAUC | 1436 |
| 10758 | AUGAACAAAGUGGAUUAUA | 170 | 10758 | AUGAACAAAGUGGAUUAUA | 170 | 10776 | UAUAAUCCACUUUGUUCAU | 1437 |
| 11232 | UAUUAUGCAGUUUAAUAUU | 171 | 11232 | UAUUAUGCAGUUUAAUAUU | 171 | 11250 | AAUAUUAAACUGCAUAAUA | 1438 |
| 11233 | AUUAUGCAGUUUAAUAUUU | 172 | 11233 | AUUAUGCAGUUUAAUAUUU | 172 | 11251 | AAAUAUUAAACUGCAUAAU | 1439 |
| 11234 | UUAUGCAGUUUAAUAUUUA | 173 | 11234 | UUAUGCAGUUUAAUAUUUA | 173 | 11252 | UAAAUAUUAAACUGCAUAA | 1440 |
| 11235 | UAUGCAGUUUAAUAUUUAG | 174 | 11235 | UAUGCAGUUUAAUAUUUAG | 174 | 11253 | CUAAAUAUUAAACUGCAUA | 1441 |
| 11795 | AUUAUGCAAAAUAUAGAAC | 175 | 11795 | AUUAUGCAAAAUAUAGAAC | 175 | 11813 | GUUCUAUAUUUUGCAUAAU | 1442 |
| 11796 | UUAUGCAAAAUAUAGAACC | 176 | 11796 | UUAUGCAAAAUAUAGAACC | 176 | 11814 | GGUUCUAUAUUUUGCAUAA | 1443 |
| 11832 | UAAGAGUUGUUUAUGAAAG | 177 | 11832 | UAAGAGUUGUUUAUGAAAG | 177 | 11850 | CUUUCAUAAACAACUCUUA | 1444 |
| 11833 | AAGAGUUGUUUAUGAAAGU | 178 | 11833 | AAGAGUUGUUUAUGAAAGU | 178 | 11851 | ACUUUCAUAAACAACUCUU | 1445 |
| 12272 | GAGAAAAAACAAUGCCAG | 179 | 12272 | GAGAAAAAACAAUGCCAG | 179 | 12290 | CUGGCAUUGUUUUUUCUC | 1446 |
| 12273 | AGAAAAAACAAUGCCAGU | 180 | 12273 | AGAAAAAACAAUGCCAGU | 180 | 12291 | ACUGGCAUUGUUUUUUCU | 1447 |
| 12383 | GAUGAAUUCAUGGAAGAAC | 181 | 12383 | GAUGAAUUCAUGGAAGAAC | 181 | 12401 | GUUCUUCCAUGAAUUCAUC | 1448 |
| 12384 | AUGAAUUCAUGGAAGAACU | 182 | 12384 | AUGAAUUCAUGGAAGAACU | 182 | 12402 | AGUUCUUCCAUGAAUUCAU | 1449 |
| 12503 | CCAUGUGAAUUCCCUGCAU | 183 | 12503 | CCAUGUGAAUUCCCUGCAU | 183 | 12521 | AUGCAGGGAAUUCACAUGG | 1450 |
| 12504 | CAUGUGAAUUCCCUGCAUC | 184 | 12504 | CAUGUGAAUUCCCUGCAUC | 184 | 12522 | GAUGCAGGGAAUUCACAUG | 1451 |
| 12505 | AUGUGAAUUCCCUGCAUCA | 185 | 12505 | AUGUGAAUUCCCUGCAUCA | 185 | 12523 | UGAUGCAGGGAAUUCACAU | 1452 |
| 12506 | UGUGAAUUCCCUGCAUCAA | 186 | 12506 | UGUGAAUUCCCUGCAUCAA | 186 | 12524 | UUGAUGCAGGGAAUUCACA | 1453 |
| 12507 | GUGAAUUCCCUGCAUCAAU | 187 | 12507 | GUGAAUUCCCUGCAUCAAU | 187 | 12525 | AUUGAUGCAGGGAAUUCAC | 1454 |
| 12508 | UGAAUUCCCUGCAUCAAUA | 188 | 12508 | UGAAUUCCCUGCAUCAAUA | 188 | 12526 | UAUUGAUGCAGGGAAUUCA | 1455 |

TABLE II-continued

RSV siNA AND TARGET SEQUENCES

| Pos | Seq | Seq ID | UPos | Upper seq | Seq ID | LPos | Lower seq | Seq ID |
|---|---|---|---|---|---|---|---|---|
| 12509 | GAAUUCCCUGCAUCAAUAC | 189 | 12509 | GAAUUCCCUGCAUCAAUAC | 189 | 12527 | GUAUUGAUGCAGGGAAUUC | 1456 |
| 12510 | AAUUCCCUGCAUCAAUACC | 190 | 12510 | AAUUCCCUGCAUCAAUACC | 190 | 12528 | GGUAUUGAUGCAGGGAAUU | 1457 |
| 12511 | AUUCCCUGCAUCAAUACCA | 191 | 12511 | AUUCCCUGCAUCAAUACCA | 191 | 12529 | UGGUAUUGAUGCAGGGAAU | 1458 |
| 12512 | UUCCCUGCAUCAAUACCAG | 192 | 12512 | UUCCCUGCAUCAAUACCAG | 192 | 12530 | CUGGUAUUGAUGCAGGGAA | 1459 |
| 12513 | UCCCUGCAUCAAUACCAGC | 193 | 12513 | UCCCUGCAUCAAUACCAGC | 193 | 12531 | GCUGGUAUUGAUGCAGGGA | 1460 |
| 12514 | CCCUGCAUCAAUACCAGCU | 194 | 12514 | CCCUGCAUCAAUACCAGCU | 194 | 12532 | AGCUGGUAUUGAUGCAGGG | 1461 |
| 12515 | CCUGCAUCAAUACCAGCUU | 195 | 12515 | CCUGCAUCAAUACCAGCUU | 195 | 12533 | AAGCUGGUAUUGAUGCAGG | 1462 |
| 12516 | CUGCAUCAAUACCAGCUUA | 196 | 12516 | CUGCAUCAAUACCAGCUUA | 196 | 12534 | UAAGCUGGUAUUGAUGCAG | 1463 |
| 12517 | UGCAUCAAUACCAGCUUAU | 197 | 12517 | UGCAUCAAUACCAGCUUAU | 197 | 12535 | AUAAGCUGGUAUUGAUGCA | 1464 |
| 12518 | GCAUCAAUACCAGCUUAUA | 198 | 12518 | GCAUCAAUACCAGCUUAUA | 198 | 12536 | UAUAAGCUGGUAUUGAUGC | 1465 |
| 12519 | CAUCAAUACCAGCUUAUAG | 199 | 12519 | CAUCAAUACCAGCUUAUAG | 199 | 12537 | CUAUAAGCUGGUAUUGAUG | 1466 |
| 12520 | AUCAAUACCAGCUUAUAGA | 200 | 12520 | AUCAAUACCAGCUUAUAGA | 200 | 12538 | UCUAUAAGCUGGUAUUGAU | 1467 |
| 12521 | UCAAUACCAGCUUAUAGAA | 201 | 12521 | UCAAUACCAGCUUAUAGAA | 201 | 12539 | UUCUAUAAGCUGGUAUUGA | 1468 |
| 12522 | CAAUACCAGCUUAUAGAAC | 202 | 12522 | CAAUACCAGCUUAUAGAAC | 202 | 12540 | GUUCUAUAAGCUGGUAUUG | 1469 |
| 12579 | UAUUAACAGAAAAGUAUGG | 203 | 12579 | UAUUAACAGAAAAGUAUGG | 203 | 12597 | CCAUACUUUUCUGUUAAUA | 1470 |
| 12779 | CAAGUGAUACAAAAACAGC | 204 | 12779 | CAAGUGAUACAAAAACAGC | 204 | 12797 | GCUGUUUUUGUAUCACUUG | 1471 |
| 12780 | AAGUGAUACAAAAACAGCA | 205 | 12780 | AAGUGAUACAAAAACAGCA | 205 | 12798 | UGCUGUUUUUGUAUCACUU | 1472 |
| 12938 | AUUUUAAGUACUAAUUUAG | 206 | 12938 | AUUUUAAGUACUAAUUUAG | 206 | 12956 | CUAAAUUAGUACUUAAAAU | 1473 |
| 12939 | UUUUAAGUACUAAUUUAGC | 207 | 12939 | UUUUAAGUACUAAUUUAGC | 207 | 12957 | GCUAAAUUAGUACUUAAAA | 1474 |
| 12940 | UUUAAGUACUAAUUUAGCU | 208 | 12940 | UUUAAGUACUAAUUUAGCU | 208 | 12958 | AGCUAAAUUAGUACUUAAA | 1475 |
| 12941 | UUAAGUACUAAUUUAGCUG | 209 | 12941 | UUAAGUACUAAUUUAGCUG | 209 | 12959 | CAGCUAAAUUAGUACUUAA | 1476 |
| 12942 | UAAGUACUAAUUUAGCUGG | 210 | 12942 | UAAGUACUAAUUUAGCUGG | 210 | 12960 | CCAGCUAAAUUAGUACUUA | 1477 |
| 12943 | AAGUACUAAUUUAGCUGGA | 211 | 12943 | AAGUACUAAUUUAGCUGGA | 211 | 12961 | UCCAGCUAAAUUAGUACUU | 1478 |
| 12944 | AGUACUAAUUUAGCUGGAC | 212 | 12944 | AGUACUAAUUUAGCUGGAC | 212 | 12962 | GUCCAGCUAAAUUAGUACU | 1479 |
| 12945 | GUACUAAUUUAGCUGGACA | 213 | 12945 | GUACUAAUUUAGCUGGACA | 213 | 12963 | UGUCCAGCUAAAUUAGUAC | 1480 |
| 12946 | UACUAAUUUAGCUGGACAU | 214 | 12946 | UACUAAUUUAGCUGGACAU | 214 | 12964 | AUGUCCAGCUAAAUUAGUA | 1481 |
| 12947 | ACUAAUUUAGCUGGACAUU | 215 | 12947 | ACUAAUUUAGCUGGACAUU | 215 | 12965 | AAUGUCCAGCUAAAUUAGU | 1482 |
| 12948 | CUAAUUUAGCUGGACAUUG | 216 | 12948 | CUAAUUUAGCUGGACAUUG | 216 | 12966 | CAAUGUCCAGCUAAAUUAG | 1483 |
| 12949 | UAAUUUAGCUGGACAUUGG | 217 | 12949 | UAAUUUAGCUGGACAUUGG | 217 | 12967 | CCAAUGUCCAGCUAAAUUA | 1484 |
| 12950 | AAUUUAGCUGGACAUUGGA | 218 | 12950 | AAUUUAGCUGGACAUUGGA | 218 | 12968 | UCCAAUGUCCAGCUAAAUU | 1485 |
| 12951 | AUUUAGCUGGACAUUGGAU | 219 | 12951 | AUUUAGCUGGACAUUGGAU | 219 | 12969 | AUCCAAUGUCCAGCUAAAU | 1486 |
| 12952 | UUUAGCUGGACAUUGGAUU | 220 | 12952 | UUUAGCUGGACAUUGGAUU | 220 | 12970 | AAUCCAAUGUCCAGCUAAA | 1487 |
| 12953 | UUAGCUGGACAUUGGAUUC | 221 | 12953 | UUAGCUGGACAUUGGAUUC | 221 | 12971 | GAAUCCAAUGUCCAGCUAA | 1488 |
| 12954 | UAGCUGGACAUUGGAUUCU | 222 | 12954 | UAGCUGGACAUUGGAUUCU | 222 | 12972 | AGAAUCCAAUGUCCAGCUA | 1489 |
| 13001 | GGUAUUUUUGAAAAGAUU | 223 | 13001 | GGUAUUUUUGAAAAGAUU | 223 | 13019 | AAUCUUUUCAAAAAUACC | 1490 |
| 13002 | GUAUUUUUGAAAAGAUUG | 224 | 13002 | GUAUUUUUGAAAAGAUUG | 224 | 13020 | CAAUCUUUUCAAAAAUAC | 1491 |
| 13003 | UAUUUUUGAAAAGAUUGG | 225 | 13003 | UAUUUUUGAAAAGAUUGG | 225 | 13021 | CCAAUCUUUUCAAAAAUA | 1492 |

TABLE II-continued

RSV siNA AND TARGET SEQUENCES

| Pos | Seq | Seq ID | UPos | Upper seq | Seq ID | LPos | Lower seq | Seq ID |
|---|---|---|---|---|---|---|---|---|
| 13004 | AUUUUUGAAAAAGAUUGGG | 226 | 13004 | AUUUUUGAAAAAGAUUGGG | 226 | 13022 | CCCAAUCUUUUUCAAAAAU | 1493 |
| 13005 | UUUUUGAAAAAGAUUGGGG | 227 | 13005 | UUUUUGAAAAAGAUUGGGG | 227 | 13023 | CCCCAAUCUUUUUCAAAAA | 1494 |
| 13006 | UUUUGAAAAAGAUUGGGGA | 228 | 13006 | UUUUGAAAAAGAUUGGGGA | 228 | 13024 | UCCCCAAUCUUUUUCAAAA | 1495 |
| 13007 | UUUGAAAAGAUUGGGGAG | 229 | 13007 | UUUGAAAAAGAUUGGGGAG | 229 | 13025 | CUCCCCAAUCUUUUUCAAA | 1496 |
| 13008 | UUGAAAAAGAUUGGGGAGA | 230 | 13008 | UUGAAAAAGAUUGGGGAGA | 230 | 13026 | UCUCCCCAAUCUUUUUCAA | 1497 |
| 13009 | UGAAAAGAUUGGGGAGAG | 231 | 13009 | UGAAAAAGAUUGGGGAGAG | 231 | 13027 | CUCUCCCCAAUCUUUUUCA | 1498 |
| 13010 | GAAAAAGAUUGGGGAGAGG | 232 | 13010 | GAAAAAGAUUGGGGAGAGG | 232 | 13028 | CCUCUCCCCAAUCUUUUUC | 1499 |
| 13011 | AAAAGAUUGGGGAGAGGG | 233 | 13011 | AAAAAGAUUGGGGAGAGGG | 233 | 13029 | CCCUCUCCCCAAUCUUUUU | 1500 |
| 13334 | UGCCCUUGGGUUGUUAACA | 234 | 13334 | UGCCCUUGGGUUGUUAACA | 234 | 13352 | UGUUAACAACCCAAGGGCA | 1501 |
| 13335 | GCCCUUGGGUUGUUAACAU | 235 | 13335 | GCCCUUGGGUUGUUAACAU | 235 | 13353 | AUGUUAACAACCCAAGGGC | 1502 |
| 13336 | CCCUUGGGUUGUUAACAUA | 236 | 13336 | CCCUUGGGUUGUUAACAUA | 236 | 13354 | UAUGUUAACAACCCAAGGG | 1503 |
| 13337 | CCUUGGGUUGUUAACAUAG | 237 | 13337 | CCUUGGGUUGUUAACAUAG | 237 | 13355 | CUAUGUUAACAACCCAAGG | 1504 |
| 13338 | CUUGGGUUGUUAACAUAGA | 238 | 13338 | CUUGGGUUGUUAACAUAGA | 238 | 13356 | UCUAUGUUAACAACCCAAG | 1505 |
| 13339 | UUGGGUUGUUAACAUAGAU | 239 | 13339 | UUGGGUUGUUAACAUAGAU | 239 | 13357 | AUCUAUGUUAACAACCCAA | 1506 |
| 13340 | UGGGUUGUUAACAUAGAUU | 240 | 13340 | UGGGUUGUUAACAUAGAUU | 240 | 13358 | AAUCUAUGUUAACAACCCA | 1507 |
| 13341 | GGGUUGUUAACAUAGAUUA | 241 | 13341 | GGGUUGUUAACAUAGAUUA | 241 | 13359 | UAAUCUAUGUUAACAACCC | 1508 |
| 13342 | GGUUGUUAACAUAGAUUAU | 242 | 13342 | GGUUGUUAACAUAGAUUAU | 242 | 13360 | AUAAUCUAUGUUAACAACC | 1509 |
| 13343 | GUUGUUAACAUAGAUUAUC | 243 | 13343 | GUUGUUAACAUAGAUUAUC | 243 | 13361 | GAUAAUCUAUGUUAACAAC | 1510 |
| 13344 | UUGUUAACAUAGAUUAUCA | 244 | 13344 | UUGUUAACAUAGAUUAUCA | 244 | 13362 | UGAUAAUCUAUGUUAACAA | 1511 |
| 13452 | ACAAAUUCAAUGAUGAAUU | 245 | 13452 | ACAAAUUCAAUGAUGAAUU | 245 | 13470 | AAUUCAUCAUUGAAUUUGU | 1512 |
| 13453 | CAAAUUCAAUGAUGAAUUU | 246 | 13453 | CAAAUUCAAUGAUGAAUUU | 246 | 13471 | AAAUUCAUCAUUGAAUUUG | 1513 |
| 13454 | AAAUUCAAUGAUGAAUUUU | 247 | 13454 | AAAUUCAAUGAUGAAUUUU | 247 | 13472 | AAAAUUCAUCAUUGAAUUU | 1514 |
| 13455 | AAUUCAAUGAUGAAUUUUA | 248 | 13455 | AAUUCAAUGAUGAAUUUUA | 248 | 13473 | UAAAAUUCAUCAUUGAAUU | 1515 |
| 13898 | UGCAUGCUUCCUUGGCAUC | 249 | 13898 | UGCAUGCUUCCUUGGCAUC | 249 | 13916 | GAUGCCAAGGAAGCAUGCA | 1516 |
| 13899 | GCAUGCUUCCUUGGCAUCA | 250 | 13899 | GCAUGCUUCCUUGGCAUCA | 250 | 13917 | UGAUGCCAAGGAAGCAUGC | 1517 |
| 13900 | CAUGCUUCCUUGGCAUCAU | 251 | 13900 | CAUGCUUCCUUGGCAUCAU | 251 | 13918 | AUGAUGCCAAGGAAGCAUG | 1518 |
| 13964 | AGUAUAGAGUAUAUUUUAA | 252 | 13964 | AGUAUAGAGUAUAUUUUAA | 252 | 13982 | UUAAAAUAUACUCUAUACU | 1519 |
| 13965 | GUAUAGAGUAUAUUUUAAA | 253 | 13965 | GUAUAGAGUAUAUUUUAAA | 253 | 13983 | UUUAAAAUAUACUCUAUAC | 1520 |
| 13966 | UAUAGAGUAUAUUUUAAAA | 254 | 13966 | UAUAGAGUAUAUUUUAAAA | 254 | 13984 | UUUUAAAAUAUACUCUAUA | 1521 |
| 13967 | AUAGAGUAUAUUUUAAAAG | 255 | 13967 | AUAGAGUAUAUUUUAAAAG | 255 | 13985 | CUUUUAAAAUAUACUCUAU | 1522 |
| 13968 | UAGAGUAUAUUUUAAAAGA | 256 | 13968 | UAGAGUAUAUUUUAAAAGA | 256 | 13986 | UCUUUUAAAAUAUACUCUA | 1523 |
| 14008 | UUGUAUAGCAUUCAUAGGU | 257 | 14008 | UUGUAUAGCAUUCAUAGGU | 257 | 14026 | ACCUAUGAAUGCUAUACAA | 1524 |
| 14009 | UGUAUAGCAUUCAUAGGUG | 258 | 14009 | UGUAUAGCAUUCAUAGGUG | 258 | 14027 | CACCUAUGAAUGCUAUACA | 1525 |
| 14010 | GUAUAGCAUUCAUAGGUGA | 259 | 14010 | GUAUAGCAUUCAUAGGUGA | 259 | 14028 | UCACCUAUGAAUGCUAUAC | 1526 |
| 14011 | UAUAGCAUUCAUAGGUGAA | 260 | 14011 | UAUAGCAUUCAUAGGUGAA | 260 | 14029 | UUCACCUAUGAAUGCUAUA | 1527 |
| 14012 | AUAGCAUUCAUAGGUGAAG | 261 | 14012 | AUAGCAUUCAUAGGUGAAG | 261 | 14030 | CUUCACCUAUGAAUGCUAU | 1528 |
| 14013 | UAGCAUUCAUAGGUGAAGG | 262 | 14013 | UAGCAUUCAUAGGUGAAGG | 262 | 14031 | CCUUCACCUAUGAAUGCUA | 1529 |
| 14014 | AGCAUUCAUAGGUGAAGGA | 263 | 14014 | AGCAUUCAUAGGUGAAGGA | 263 | 14032 | UCCUUCACCUAUGAAUGCU | 1530 |

TABLE II-continued

RSV siNA AND TARGET SEQUENCES

| Pos | Seq | Seq ID | UPos | Upper seq | Seq ID | LPos | Lower seq | Seq ID |
|---|---|---|---|---|---|---|---|---|
| 14015 | GCAUUCAUAGGUGAAGGAG | 264 | 14015 | GCAUUCAUAGGUGAAGGAG | 264 | 14033 | CUCCUUCACCUAUGAAUGC | 1531 |
| 14016 | CAUUCAUAGGUGAAGGAGC | 265 | 14016 | CAUUCAUAGGUGAAGGAGC | 265 | 14034 | GCUCCUUCACCUAUGAAUG | 1532 |
| 14186 | ACCAUUCCUGCUACAGAUG | 266 | 14186 | ACCAUUCCUGCUACAGAUG | 266 | 14204 | CAUCUGUAGCAGGAAUGGU | 1533 |
| 14187 | CCAUUCCUGCUACAGAUGC | 267 | 14187 | CCAUUCCUGCUACAGAUGC | 267 | 14205 | GCAUCUGUAGCAGGAAUGG | 1534 |
| 14188 | CAUUCCUGCUACAGAUGCA | 268 | 14188 | CAUUCCUGCUACAGAUGCA | 268 | 14206 | UGCAUCUGUAGCAGGAAUG | 1535 |
| 14189 | AUUCCUGCUACAGAUGCAA | 269 | 14189 | AUUCCUGCUACAGAUGCAA | 269 | 14207 | UUGCAUCUGUAGCAGGAAU | 1536 |
| 14190 | UUCCUGCUACAGAUGCAAC | 270 | 14190 | UUCCUGCUACAGAUGCAAC | 270 | 14208 | GUUGCAUCUGUAGCAGGAA | 1537 |
| 14213 | AACAUUCAUUGGUCUUAUU | 271 | 14213 | AACAUUCAUUGGUCUUAUU | 271 | 14231 | AAUAAGACCAAUGAAUGUU | 1538 |
| 14214 | ACAUUCAUUGGUCUUAUUU | 272 | 14214 | ACAUUCAUUGGUCUUAUUU | 272 | 14232 | AAAUAAGACCAAUGAAUGU | 1539 |
| 14215 | CAUUCAUUGGUCUUAUUUA | 273 | 14215 | CAUUCAUUGGUCUUAUUUA | 273 | 14233 | UAAAUAAGACCAAUGAAUG | 1540 |
| 14216 | AUUCAUUGGUCUUAUUUAC | 274 | 14216 | AUUCAUUGGUCUUAUUUAC | 274 | 14234 | GUAAAUAAGACCAAUGAAU | 1541 |
| 14217 | UUCAUUGGUCUUAUUUACA | 275 | 14217 | UUCAUUGGUCUUAUUUACA | 275 | 14235 | UGUAAAUAAGACCAAUGAA | 1542 |
| 14218 | UCAUUGGUCUUAUUUACAU | 276 | 14218 | UCAUUGGUCUUAUUUACAU | 276 | 14236 | AUGUAAAUAAGACCAAUGA | 1543 |
| 14219 | CAUUGGUCUUAUUUACAUA | 277 | 14219 | CAUUGGUCUUAUUUACAUA | 277 | 14237 | UAUGUAAAUAAGACCAAUG | 1544 |
| 14220 | AUUGGUCUUAUUUACAUAU | 278 | 14220 | AUUGGUCUUAUUUACAUAU | 278 | 14238 | AUAUGUAAAUAAGACCAAU | 1545 |
| 14221 | UUGGUCUUAUUUACAUAUA | 279 | 14221 | UUGGUCUUAUUUACAUAUA | 279 | 14239 | UAUAUGUAAAUAAGACCAA | 1546 |
| 14222 | UGGUCUUAUUUACAUAUAA | 280 | 14222 | UGGUCUUAUUUACAUAUAA | 280 | 14240 | UUAUAUGUAAAUAAGACCA | 1547 |
| 14223 | GGUCUUAUUUACAUAUAAA | 281 | 14223 | GGUCUUAUUUACAUAUAAA | 281 | 14241 | UUUAUAUGUAAAUAAGACC | 1548 |
| 14383 | AAAAUAUCAUGCUCAAGAU | 282 | 14383 | AAAAUAUCAUGCUCAAGAU | 282 | 14401 | AUCUUGAGCAUGAUAUUUU | 1549 |
| 14384 | AAAUAUCAUGCUCAAGAUG | 283 | 14384 | AAAUAUCAUGCUCAAGAUG | 283 | 14402 | CAUCUUGAGCAUGAUAUUU | 1550 |
| 14385 | AAUAUCAUGCUCAAGAUGA | 284 | 14385 | AAUAUCAUGCUCAAGAUGA | 284 | 14403 | UCAUCUUGAGCAUGAUAUU | 1551 |
| 14386 | AUAUCAUGCUCAAGAUGAU | 285 | 14386 | AUAUCAUGCUCAAGAUGAU | 285 | 14404 | AUCAUCUUGAGCAUGAUAU | 1552 |
| 14387 | UAUCAUGCUCAAGAUGAUA | 286 | 14387 | UAUCAUGCUCAAGAUGAUA | 286 | 14405 | UAUCAUCUUGAGCAUGAUA | 1553 |
| 14388 | AUCAUGCUCAAGAUGAUAU | 287 | 14388 | AUCAUGCUCAAGAUGAUAU | 287 | 14406 | AUAUCAUCUUGAGCAUGAU | 1554 |
| 14480 | GUUUACUUAGUCCUUACAA | 288 | 14480 | GUUUACUUAGUCCUUACAA | 288 | 14498 | UUGUAAGGACUAAGUAAAC | 1555 |
| 14481 | UUUACUUAGUCCUUACAAU | 289 | 14481 | UUUACUUAGUCCUUACAAU | 289 | 14499 | AUUGUAAGGACUAAGUAAA | 1556 |
| 14482 | UUACUUAGUCCUUACAAUA | 290 | 14482 | UUACUUAGUCCUUACAAUA | 290 | 14500 | UAUUGUAAGGACUAAGUAA | 1557 |
| 14483 | UACUUAGUCCUUACAAUAG | 291 | 14483 | UACUUAGUCCUUACAAUAG | 291 | 14501 | CUAUUGUAAGGACUAAGUA | 1558 |
| 14484 | ACUUAGUCCUUACAAUAGG | 292 | 14484 | ACUUAGUCCUUACAAUAGG | 292 | 14502 | CCUAUUGUAAGGACUAAGU | 1559 |
| 14639 | CUUUGUUACCCUAUAACAA | 293 | 14639 | CUUUGUUACCCUAUAACAA | 293 | 14657 | UUGUUAUAGGGUAACAAAG | 1560 |
| 14640 | UUUGUUACCCUAUAACAAA | 294 | 14640 | UUUGUUACCCUAUAACAAA | 294 | 14658 | UUUGUUAUAGGGUAACAAA | 1561 |
| 14641 | UUGUUACCCUAUAACAAAA | 295 | 14641 | UUGUUACCCUAUAACAAAA | 295 | 14659 | UUUUGUUAUAGGGUAACAA | 1562 |
| 14642 | UGUUACCCUAUAACAAAAA | 296 | 14642 | UGUUACCCUAUAACAAAAA | 296 | 14660 | UUUUUGUUAUAGGGUAACA | 1563 |
| 14643 | GUUACCCUAUAACAAAAAA | 297 | 14643 | GUUACCCUAUAACAAAAAA | 297 | 14661 | UUUUUUGUUAUAGGGUAAC | 1564 |
| 14644 | UUACCCUAUAACAAAAAAA | 298 | 14644 | UUACCCUAUAACAAAAAAA | 298 | 14662 | UUUUUUUGUUAUAGGGUAA | 1565 |
| 14645 | UACCCUAUAACAAAAAAAG | 299 | 14645 | UACCCUAUAACAAAAAAAG | 299 | 14663 | CUUUUUUUGUUAUAGGGUA | 1566 |
| 14646 | ACCCUAUAACAAAAAAAGG | 300 | 14646 | ACCCUAUAACAAAAAAAGG | 300 | 14664 | CCUUUUUUUGUUAUAGGGU | 1567 |

TABLE II-continued

RSV siNA AND TARGET SEQUENCES

| Pos | Seq | Seq ID | UPos | Upper seq | Seq ID | LPos | Lower seq | Seq ID |
|---|---|---|---|---|---|---|---|---|
| 14647 | CCCUAUAACAAAAAAGGA | 301 | 14647 | CCCUAUAACAAAAAAGGA | 301 | 14665 | UCCUUUUUUUGUUAUAGGG | 1568 |
| 14648 | CCUAUAACAAAAAAGGAA | 302 | 14648 | CCUAUAACAAAAAAGGAA | 302 | 14666 | UUCCUUUUUUGUUAUAGG | 1569 |
| 14649 | CUAUAACAAAAAAGGAAU | 303 | 14649 | CUAUAACAAAAAAGGAAU | 303 | 14667 | AUUCCUUUUUUGUUAUAG | 1570 |
| 14650 | UAUAACAAAAAAGGAAUU | 304 | 14650 | UAUAACAAAAAAGGAAUU | 304 | 14668 | AAUUCCUUUUUUGUUAUA | 1571 |
| 14651 | AUAACAAAAAAGGAAUUA | 305 | 14651 | AUAACAAAAAAGGAAUUA | 305 | 14669 | UAAUUCCUUUUUUGUUAU | 1572 |
| 14652 | UAACAAAAAAGGAAUUAA | 306 | 14652 | UAACAAAAAAGGAAUUAA | 306 | 14670 | UUAAUUCCUUUUUUGUUA | 1573 |
| 15165 | AUUAGUUUUUGACACUUUU | 307 | 15165 | AUUAGUUUUUGACACUUUU | 307 | 15183 | AAAAGUGUCAAAACUAAU | 1574 |
| 15166 | UUAGUUUUUGACACUUUUU | 308 | 15166 | UUAGUUUUUGACACUUUUU | 308 | 15184 | AAAAAGUGUCAAAACUAA | 1575 |
| 15167 | UAGUUUUUGACACUUUUUU | 309 | 15167 | UAGUUUUUGACACUUUUUU | 309 | 15185 | AAAAAAGUGUCAAAACUA | 1576 |
| 15168 | AGUUUUUGACACUUUUUUU | 310 | 15168 | AGUUUUUGACACUUUUUUU | 310 | 15186 | AAAAAAAGUGUCAAAACU | 1577 |
| 15169 | GUUUUUGACACUUUUUUUC | 311 | 15169 | GUUUUUGACACUUUUUUUC | 311 | 15187 | GAAAAAAAGUGUCAAAAC | 1578 |
| 15170 | UUUUUGACACUUUUUUUCU | 312 | 15170 | UUUUUGACACUUUUUUUCU | 312 | 15188 | AGAAAAAAAGUGUCAAAA | 1579 |
| 15171 | UUUUGACACUUUUUUUCUC | 313 | 15171 | UUUUGACACUUUUUUUCUC | 313 | 15189 | GAGAAAAAAAGUGUCAAAA | 1580 |
| 1520 | UGAGAUAGAAUCUAGAAAA | 314 | 1520 | UGAGAUAGAAUCUAGAAAA | 314 | 1538 | UUUUCUAGAUUCUAUCUCA | 1581 |
| 1521 | GAGAUAGAAUCUAGAAAAU | 315 | 1521 | GAGAUAGAAUCUAGAAAAU | 315 | 1539 | AUUUUCUAGAUUCUAUCUC | 1582 |
| 1522 | AGAUAGAAUCUAGAAAAUC | 316 | 1522 | AGAUAGAAUCUAGAAAAUC | 316 | 1540 | GAUUUUCUAGAUUCUAUCU | 1583 |
| 1523 | GAUAGAAUCUAGAAAAUCC | 317 | 1523 | GAUAGAAUCUAGAAAAUCC | 317 | 1541 | GGAUUUUCUAGAUUCUAUC | 1584 |
| 1524 | AUAGAAUCUAGAAAAUCCU | 318 | 1524 | AUAGAAUCUAGAAAAUCCU | 318 | 1542 | AGGAUUUUCUAGAUUCUAU | 1585 |
| 1525 | UAGAAUCUAGAAAAUCCUA | 319 | 1525 | UAGAAUCUAGAAAAUCCUA | 319 | 1543 | UAGGAUUUUCUAGAUUCUA | 1586 |
| 1526 | AGAAUCUAGAAAAUCCUAC | 320 | 1526 | AGAAUCUAGAAAAUCCUAC | 320 | 1544 | GUAGGAUUUUCUAGAUUCU | 1587 |
| 1527 | GAAUCUAGAAAAUCCUACA | 321 | 1527 | GAAUCUAGAAAAUCCUACA | 321 | 1545 | UGUAGGAUUUUCUAGAUUC | 1588 |
| 1528 | AAUCUAGAAAAUCCUACAA | 322 | 1528 | AAUCUAGAAAAUCCUACAA | 322 | 1546 | UUGUAGGAUUUUCUAGAUU | 1589 |
| 1529 | AUCUAGAAAAUCCUACAAA | 323 | 1529 | AUCUAGAAAAUCCUACAAA | 323 | 1547 | UUUGUAGGAUUUUCUAGAU | 1590 |
| 1530 | UCUAGAAAAUCCUACAAAA | 324 | 1530 | UCUAGAAAAUCCUACAAAA | 324 | 1548 | UUUUGUAGGAUUUUCUAGA | 1591 |
| 1531 | CUAGAAAAUCCUACAAAAA | 325 | 1531 | CUAGAAAAUCCUACAAAAA | 325 | 1549 | UUUUUGUAGGAUUUUCUAG | 1592 |
| 1532 | UAGAAAAUCCUACAAAAAA | 326 | 1532 | UAGAAAAUCCUACAAAAAA | 326 | 1550 | UUUUUUGUAGGAUUUUCUA | 1593 |
| 1533 | AGAAAAUCCUACAAAAAAA | 327 | 1533 | AGAAAAUCCUACAAAAAAA | 327 | 1551 | UUUUUUUGUAGGAUUUUCU | 1594 |
| 1534 | GAAAAUCCUACAAAAAAAU | 328 | 1534 | GAAAAUCCUACAAAAAAAU | 328 | 1552 | AUUUUUUUGUAGGAUUUUC | 1595 |
| 1535 | AAAAUCCUACAAAAAAAUG | 329 | 1535 | AAAAUCCUACAAAAAAAUG | 329 | 1553 | CAUUUUUUUGUAGGAUUUU | 1596 |
| 1536 | AAAUCCUACAAAAAAAUGC | 330 | 1536 | AAAUCCUACAAAAAAAUGC | 330 | 1554 | GCAUUUUUUUGUAGGAUUU | 1597 |
| 1537 | AAUCCUACAAAAAAAUGCU | 331 | 1537 | AAUCCUACAAAAAAAUGCU | 331 | 1555 | AGCAUUUUUUUGUAGGAUU | 1598 |
| 1538 | AUCCUACAAAAAAAUGCUA | 332 | 1538 | AUCCUACAAAAAAAUGCUA | 332 | 1556 | UAGCAUUUUUUUGUAGGAU | 1599 |
| 1872 | GGAUUGUUUAUGAAUGCCU | 333 | 1872 | GGAUUGUUUAUGAAUGCCU | 333 | 1890 | AGGCAUUCAUAAACAAUCC | 1600 |
| 1873 | GAUUGUUUAUGAAUGCCUA | 334 | 1873 | GAUUGUUUAUGAAUGCCUA | 334 | 1891 | UAGGCAUUCAUAAACAAUC | 1601 |
| 1874 | AUUGUUUAUGAAUGCCUAU | 335 | 1874 | AUUGUUUAUGAAUGCCUAU | 335 | 1892 | AUAGGCAUUCAUAAACAAU | 1602 |
| 1875 | UUGUUUAUGAAUGCCUAUG | 336 | 1875 | UUGUUUAUGAAUGCCUAUG | 336 | 1893 | CAUAGGCAUUCAUAAACAA | 1603 |
| 1876 | UGUUUAUGAAUGCCUAUGG | 337 | 1876 | UGUUUAUGAAUGCCUAUGG | 337 | 1894 | CCAUAGGCAUUCAUAAACA | 1604 |
| 1877 | GUUUAUGAAUGCCUAUGGU | 338 | 1877 | GUUUAUGAAUGCCUAUGGU | 338 | 1895 | ACCAUAGGCAUUCAUAAAC | 1605 |

TABLE II-continued

RSV siNA AND TARGET SEQUENCES

| Pos | Seq | Seq ID | UPos | Upper seq | Seq ID | LPos | Lower seq | Seq ID |
|---|---|---|---|---|---|---|---|---|
| 2482 | AAUAGAUAUAGAAGUAACC | 339 | 2482 | AAUAGAUAUAGAAGUAACC | 339 | 2500 | GGUUACUUCUAUAUCUAUU | 1606 |
| 2483 | AUAGAUAUAGAAGUAACCA | 340 | 2483 | AUAGAUAUAGAAGUAACCA | 340 | 2501 | UGGUUACUUCUAUAUCUAU | 1607 |
| 2484 | UAGAUAUAGAAGUAACCAA | 341 | 2484 | UAGAUAUAGAAGUAACCAA | 341 | 2502 | UUGGUUACUUCUAUAUCUA | 1608 |
| 2485 | AGAUAUAGAAGUAACCAAA | 342 | 2485 | AGAUAUAGAAGUAACCAAA | 342 | 2503 | UUUGGUUACUUCUAUAUCU | 1609 |
| 2486 | GAUAUAGAAGUAACCAAAG | 343 | 2486 | GAUAUAGAAGUAACCAAAG | 343 | 2504 | CUUUGGUUACUUCUAUAUC | 1610 |
| 2487 | AUAUAGAAGUAACCAAAGA | 344 | 2487 | AUAUAGAAGUAACCAAAGA | 344 | 2505 | UCUUUGGUUACUUCUAUAU | 1611 |
| 2663 | AUAGAAACAUUUGAUAACA | 345 | 2663 | AUAGAAACAUUUGAUAACA | 345 | 2681 | UGUUAUCAAAUGUUUCUAU | 1612 |
| 2664 | UAGAAACAUUUGAUAACAA | 346 | 2664 | UAGAAACAUUUGAUAACAA | 346 | 2682 | UUGUUAUCAAAUGUUUCUA | 1613 |
| 2665 | AGAAACAUUUGAUAACAAU | 347 | 2665 | AGAAACAUUUGAUAACAAU | 347 | 2683 | AUUGUUAUCAAAUGUUUCU | 1614 |
| 2666 | GAAACAUUUGAUAACAAUG | 348 | 2666 | GAAACAUUUGAUAACAAUG | 348 | 2684 | CAUUGUUAUCAAAUGUUUC | 1615 |
| 2667 | AAACAUUUGAUAACAAUGA | 349 | 2667 | AAACAUUUGAUAACAAUGA | 349 | 2685 | UCAUUGUUAUCAAAUGUUU | 1616 |
| 2668 | AACAUUUGAUAACAAUGAA | 350 | 2668 | AACAUUUGAUAACAAUGAA | 350 | 2686 | UUCAUUGUUAUCAAAUGUU | 1617 |
| 4795 | UGGCAAUGAUAAUCUCAAC | 351 | 4795 | UGGCAAUGAUAAUCUCAAC | 351 | 4813 | GUUGAGAUUAUCAUUGCCA | 1618 |
| 5866 | AUAAAACAAGAAUUAGAUA | 352 | 5866 | AUAAAACAAGAAUUAGAUA | 352 | 5884 | UAUCUAAUUCUUGUUUUAU | 1619 |
| 5867 | UAAAACAAGAAUUAGAUAA | 353 | 5867 | UAAAACAAGAAUUAGAUAA | 353 | 5885 | UUAUCUAAUUCUUGUUUUA | 1620 |
| 6412 | AUCAAUGAUAUGCCUAUAA | 354 | 6412 | AUCAAUGAUAUGCCUAUAA | 354 | 6430 | UUAUAGGCAUAUCAUUGAU | 1621 |
| 6413 | UCAAUGAUAUGCCUAUAAC | 355 | 6413 | UCAAUGAUAUGCCUAUAAC | 355 | 6431 | GUUAUAGGCAUAUCAUUGA | 1622 |
| 6414 | CAAUGAUAUGCCUAUAACA | 356 | 6414 | CAAUGAUAUGCCUAUAACA | 356 | 6432 | UGUUAUAGGCAUAUCAUUG | 1623 |
| 6415 | AAUGAUAUGCCUAUAACAA | 357 | 6415 | AAUGAUAUGCCUAUAACAA | 357 | 6433 | UUGUUAUAGGCAUAUCAUU | 1624 |
| 6416 | AUGAUAUGCCUAUAACAAA | 358 | 6416 | AUGAUAUGCCUAUAACAAA | 358 | 6434 | UUUGUUAUAGGCAUAUCAU | 1625 |
| 6417 | UGAUAUGCCUAUAACAAAU | 359 | 6417 | UGAUAUGCCUAUAACAAAU | 359 | 6435 | AUUUGUUAUAGGCAUAUCA | 1626 |
| 6418 | GAUAUGCCUAUAACAAAUG | 360 | 6418 | GAUAUGCCUAUAACAAAUG | 360 | 6436 | CAUUUGUUAUAGGCAUAUC | 1627 |
| 6419 | AUAUGCCUAUAACAAAUGA | 361 | 6419 | AUAUGCCUAUAACAAAUGA | 361 | 6437 | UCAUUUGUUAUAGGCAUAU | 1628 |
| 6420 | UAUGCCUAUAACAAAUGAU | 362 | 6420 | UAUGCCUAUAACAAAUGAU | 362 | 6438 | AUCAUUUGUUAUAGGCAUA | 1629 |
| 6421 | AUGCCUAUAACAAAUGAUC | 363 | 6421 | AUGCCUAUAACAAAUGAUC | 363 | 6439 | GAUCAUUUGUUAUAGGCAU | 1630 |
| 6422 | UGCCUAUAACAAAUGAUCA | 364 | 6422 | UGCCUAUAACAAAUGAUCA | 364 | 6440 | UGAUCAUUUGUUAUAGGCA | 1631 |
| 6423 | GCCUAUAACAAAUGAUCAG | 365 | 6423 | GCCUAUAACAAAUGAUCAG | 365 | 6441 | CUGAUCAUUUGUUAUAGGC | 1632 |
| 6424 | CCUAUAACAAAUGAUCAGA | 366 | 6424 | CCUAUAACAAAUGAUCAGA | 366 | 6442 | UCUGAUCAUUUGUUAUAGG | 1633 |
| 6425 | CUAUAACAAAUGAUCAGAA | 367 | 6425 | CUAUAACAAAUGAUCAGAA | 367 | 6443 | UUCUGAUCAUUUGUUAUAG | 1634 |
| 6426 | UAUAACAAAUGAUCAGAAA | 368 | 6426 | UAUAACAAAUGAUCAGAAA | 368 | 6444 | UUUCUGAUCAUUUGUUAUA | 1635 |
| 8378 | ACAAUAUAUAUUAGUGU | 369 | 8378 | ACAAUAUAUAUUAGUGU | 369 | 8396 | ACACUAAUAUAUAUUGU | 1636 |
| 8379 | CAAUAUAUAUUAGUGUC | 370 | 8379 | CAAUAUAUAUUAGUGUC | 370 | 8397 | GACACUAAUAUAUAUUG | 1637 |
| 8380 | AAUAUAUAUUAGUGUCA | 371 | 8380 | AAUAUAUAUUAGUGUCA | 371 | 8398 | UGACACUAAUAUAUAUU | 1638 |
| 8381 | AUAUAUAUUAGUGUCAU | 372 | 8381 | AUAUAUAUUAGUGUCAU | 372 | 8399 | AUGACACUAAUAUAUAU | 1639 |
| 8513 | GAUAGUUAUUUAAAGGUG | 373 | 8513 | GAUAGUUAUUUAAAGGUG | 373 | 8531 | CACCUUUUAAAUAACUAUC | 1640 |
| 8514 | AUAGUUAUUUAAAGGUGU | 374 | 8514 | AUAGUUAUUUAAAGGUGU | 374 | 8532 | ACACCUUUUAAAUAACUAU | 1641 |
| 8515 | UAGUUAUUUAAAGGUGUU | 375 | 8515 | UAGUUAUUUAAAGGUGUU | 375 | 8533 | AACACCUUUUAAAUAACUA | 1642 |

TABLE II-continued

RSV siNA AND TARGET SEQUENCES

| Pos | Seq | Seq ID | UPos | Upper seq | Seq ID | LPos | Lower seq | Seq ID |
|---|---|---|---|---|---|---|---|---|
| 8516 | AGUUAUUUAAAAGGUGUUA | 376 | 8516 | AGUUAUUUAAAAGGUGUUA | 376 | 8534 | UAACACCUUUUAAAUAACU | 1643 |
| 8517 | GUUAUUUAAAAGGUGUUAU | 377 | 8517 | GUUAUUUAAAAGGUGUUAU | 377 | 8535 | AUAACACCUUUUAAAUAAC | 1644 |
| 8582 | CCUUAUCUCAAAAAUGAUU | 378 | 8582 | CCUUAUCUCAAAAAUGAUU | 378 | 8600 | AAUCAUUUUUGAGAUAAGG | 1645 |
| 8583 | CUUAUCUCAAAAAUGAUUA | 379 | 8583 | CUUAUCUCAAAAAUGAUUA | 379 | 8601 | UAAUCAUUUUUGAGAUAAG | 1646 |
| 8603 | ACCAACUUAAUUAGUAGAC | 380 | 8603 | ACCAACUUAAUUAGUAGAC | 380 | 8621 | GUCUACUAAUUAAGUUGGU | 1647 |
| 8604 | CCAACUUAAUUAGUAGACA | 381 | 8604 | CCAACUUAAUUAGUAGACA | 381 | 8622 | UGUCUACUAAUUAAGUUGG | 1648 |
| 8605 | CAACUUAAUUAGUAGACAA | 382 | 8605 | CAACUUAAUUAGUAGACAA | 382 | 8623 | UUGUCUACUAAUUAAGUUG | 1649 |
| 9047 | AUGUGUUCAAUGCAACAUC | 383 | 9047 | AUGUGUUCAAUGCAACAUC | 383 | 9065 | GAUGUUGCAUUGAACACAU | 1650 |
| 9048 | UGUGUUCAAUGCAACAUCC | 384 | 9048 | UGUGUUCAAUGCAACAUCC | 384 | 9066 | GGAUGUUGCAUUGAACACA | 1651 |
| 9049 | GUGUUCAAUGCAACAUCCU | 385 | 9049 | GUGUUCAAUGCAACAUCCU | 385 | 9067 | AGGAUGUUGCAUUGAACAC | 1652 |
| 9050 | UGUUCAAUGCAACAUCCUC | 386 | 9050 | UGUUCAAUGCAACAUCCUC | 386 | 9068 | GAGGAUGUUGCAUUGAACA | 1653 |
| 9051 | GUUCAAUGCAACAUCCUCC | 387 | 9051 | GUUCAAUGCAACAUCCUCC | 387 | 9069 | GGAGGAUGUUGCAUUGAAC | 1654 |
| 9052 | UUCAAUGCAACAUCCUCCA | 388 | 9052 | UUCAAUGCAACAUCCUCCA | 388 | 9070 | UGGAGGAUGUUGCAUUGAA | 1655 |
| 9053 | UCAAUGCAACAUCCUCCAU | 389 | 9053 | UCAAUGCAACAUCCUCCAU | 389 | 9071 | AUGGAGGAUGUUGCAUUGA | 1656 |
| 9054 | CAAUGCAACAUCCUCCAUC | 390 | 9054 | CAAUGCAACAUCCUCCAUC | 390 | 9072 | GAUGGAGGAUGUUGCAUUG | 1657 |
| 9055 | AAUGCAACAUCCUCCAUCA | 391 | 9055 | AAUGCAACAUCCUCCAUCA | 391 | 9073 | UGAUGGAGGAUGUUGCAUU | 1658 |
| 9056 | AUGCAACAUCCUCCAUCAU | 392 | 9056 | AUGCAACAUCCUCCAUCAU | 392 | 9074 | AUGAUGGAGGAUGUUGCAU | 1659 |
| 9057 | UGCAACAUCCUCCAUCAUG | 393 | 9057 | UGCAACAUCCUCCAUCAUG | 393 | 9075 | CAUGAUGGAGGAUGUUGCA | 1660 |
| 9058 | GCAACAUCCUCCAUCAUGG | 394 | 9058 | GCAACAUCCUCCAUCAUGG | 394 | 9076 | CCAUGAUGGAGGAUGUUGC | 1661 |
| 9059 | CAACAUCCUCCAUCAUGGU | 395 | 9059 | CAACAUCCUCCAUCAUGGU | 395 | 9077 | ACCAUGAUGGAGGAUGUUG | 1662 |
| 9060 | AACAUCCUCCAUCAUGGUU | 396 | 9060 | AACAUCCUCCAUCAUGGUU | 396 | 9078 | AACCAUGAUGGAGGAUGUU | 1663 |
| 9061 | ACAUCCUCCAUCAUGGUUA | 397 | 9061 | ACAUCCUCCAUCAUGGUUA | 397 | 9079 | UAACCAUGAUGGAGGAUGU | 1664 |
| 10847 | GAUCUAAUAUCUCUCAAAG | 398 | 10847 | GAUCUAAUAUCUCUCAAAG | 398 | 10865 | CUUUGAGAGAUAUUAGAUC | 1665 |
| 10848 | AUCUAAUAUCUCUCAAAGG | 399 | 10848 | AUCUAAUAUCUCUCAAAGG | 399 | 10866 | CCUUUGAGAGAUAUUAGAU | 1666 |
| 10849 | UCUAAUAUCUCUCAAAGGG | 400 | 10849 | UCUAAUAUCUCUCAAAGGG | 400 | 10867 | CCCUUUGAGAGAUAUUAGA | 1667 |
| 10850 | CUAAUAUCUCUCAAAGGGA | 401 | 10850 | CUAAUAUCUCUCAAAGGGA | 401 | 10868 | UCCCUUUGAGAGAUAUUAG | 1668 |
| 10851 | UAAUAUCUCUCAAAGGGAA | 402 | 10851 | UAAUAUCUCUCAAAGGGAA | 402 | 10869 | UUCCCUUUGAGAGAUAUUA | 1669 |
| 10852 | AAUAUCUCUCAAAGGGAAA | 403 | 10852 | AAUAUCUCUCAAAGGGAAA | 403 | 10870 | UUUCCCUUUGAGAGAUAUU | 1670 |
| 10853 | AUAUCUCUCAAAGGGAAAU | 404 | 10853 | AUAUCUCUCAAAGGGAAAU | 404 | 10871 | AUUUCCCUUUGAGAGAUAU | 1671 |
| 10854 | UAUCUCUCAAAGGGAAAUU | 405 | 10854 | UAUCUCUCAAAGGGAAAUU | 405 | 10872 | AAUUUCCCUUUGAGAGAUA | 1672 |
| 10855 | AUCUCUCAAAGGGAAAUUC | 406 | 10855 | AUCUCUCAAAGGGAAAUUC | 406 | 10873 | GAAUUUCCCUUUGAGAGAU | 1673 |
| 10856 | UCUCUCAAAGGGAAAUUCU | 407 | 10856 | UCUCUCAAAGGGAAAUUCU | 407 | 10874 | AGAAUUUCCCUUUGAGAGA | 1674 |
| 10857 | CUCUCAAAGGGAAAUUCUC | 408 | 10857 | CUCUCAAAGGGAAAUUCUC | 408 | 10875 | GAGAAUUUCCCUUUGAGAG | 1675 |
| 12488 | ACAGUCAGUAGUAGACCAU | 409 | 12488 | ACAGUCAGUAGUAGACCAU | 409 | 12506 | AUGGUCUACUACUGACUGU | 1676 |
| 12489 | CAGUCAGUAGUAGACCAUG | 410 | 12489 | CAGUCAGUAGUAGACCAUG | 410 | 12507 | CAUGGUCUACUACUGACUG | 1677 |
| 12490 | AGUCAGUAGUAGACCAUGU | 411 | 12490 | AGUCAGUAGUAGACCAUGU | 411 | 12508 | ACAUGGUCUACUACUGACU | 1678 |
| 12491 | GUCAGUAGUAGACCAUGUG | 412 | 12491 | GUCAGUAGUAGACCAUGUG | 412 | 12509 | CACAUGGUCUACUACUGAC | 1679 |
| 12492 | UCAGUAGUAGACCAUGUGA | 413 | 12492 | UCAGUAGUAGACCAUGUGA | 413 | 12510 | UCACAUGGUCUACUACUGA | 1680 |

TABLE II-continued

RSV siNA AND TARGET SEQUENCES

| Pos | Seq | Seq ID | UPos | Upper seq | Seq ID | LPos | Lower seq | Seq ID |
|---|---|---|---|---|---|---|---|---|
| 12493 | CAGUAGUAGACCAUGUGAA | 414 | 12493 | CAGUAGUAGACCAUGUGAA | 414 | 12511 | UUCACAUGGUCUACUACUG | 1681 |
| 12494 | AGUAGUAGACCAUGUGAAU | 415 | 12494 | AGUAGUAGACCAUGUGAAU | 415 | 12512 | AUUCACAUGGUCUACUACU | 1682 |
| 12495 | GUAGUAGACCAUGUGAAUU | 416 | 12495 | GUAGUAGACCAUGUGAAUU | 416 | 12513 | AAUUCACAUGGUCUACUAC | 1683 |
| 12496 | UAGUAGACCAUGUGAAUUC | 417 | 12496 | UAGUAGACCAUGUGAAUUC | 417 | 12514 | GAAUUCACAUGGUCUACUA | 1684 |
| 12497 | AGUAGACCAUGUGAAUUCC | 418 | 12497 | AGUAGACCAUGUGAAUUCC | 418 | 12515 | GGAAUUCACAUGGUCUACU | 1685 |
| 12498 | GUAGACCAUGUGAAUUCCC | 419 | 12498 | GUAGACCAUGUGAAUUCCC | 419 | 12516 | GGGAAUUCACAUGGUCUAC | 1686 |
| 12499 | UAGACCAUGUGAAUUCCCU | 420 | 12499 | UAGACCAUGUGAAUUCCCU | 420 | 12517 | AGGGAAUUCACAUGGUCUA | 1687 |
| 12500 | AGACCAUGUGAAUUCCCUG | 421 | 12500 | AGACCAUGUGAAUUCCCUG | 421 | 12518 | CAGGGAAUUCACAUGGUCU | 1688 |
| 12501 | GACCAUGUGAAUUCCCUGC | 422 | 12501 | GACCAUGUGAAUUCCCUGC | 422 | 12519 | GCAGGGAAUUCACAUGGUC | 1689 |
| 12502 | ACCAUGUGAAUUCCCUGCA | 423 | 12502 | ACCAUGUGAAUUCCCUGCA | 423 | 12520 | UGCAGGGAAUUCACAUGGU | 1690 |
| 12781 | AGUGAUACAAAAACAGCAU | 424 | 12781 | AGUGAUACAAAAACAGCAU | 424 | 12799 | AUGCUGUUUUUGUAUCACU | 1691 |
| 12782 | GUGAUACAAAAACAGCAUA | 425 | 12782 | GUGAUACAAAAACAGCAUA | 425 | 12800 | UAUGCUGUUUUUGUAUCAC | 1692 |
| 12783 | UGAUACAAAAACAGCAUAU | 426 | 12783 | UGAUACAAAAACAGCAUAU | 426 | 12801 | AUAUGCUGUUUUUGUAUCA | 1693 |
| 12784 | GAUACAAAAACAGCAUAUG | 427 | 12784 | GAUACAAAAACAGCAUAUG | 427 | 12802 | CAUAUGCUGUUUUUGUAUC | 1694 |
| 12785 | AUACAAAAACAGCAUAUGU | 428 | 12785 | AUACAAAAACAGCAUAUGU | 428 | 12803 | ACAUAUGCUGUUUUUGUAU | 1695 |
| 12786 | UACAAAAACAGCAUAUGUU | 429 | 12786 | UACAAAAACAGCAUAUGUU | 429 | 12804 | AACAUAUGCUGUUUUUGUA | 1696 |
| 14105 | GAUUGCAAUGAUCAUAGUU | 430 | 14105 | GAUUGCAAUGAUCAUAGUU | 430 | 14123 | AACUAUGAUCAUUGCAAUC | 1697 |
| 14106 | AUUGCAAUGAUCAUAGUUU | 431 | 14106 | AUUGCAAUGAUCAUAGUUU | 431 | 14124 | AAACUAUGAUCAUUGCAAU | 1698 |
| 14107 | UUGCAAUGAUCAUAGUUUA | 432 | 14107 | UUGCAAUGAUCAUAGUUUA | 432 | 14125 | UAAACUAUGAUCAUUGCAA | 1699 |
| 14108 | UGCAAUGAUCAUAGUUUAC | 433 | 14108 | UGCAAUGAUCAUAGUUUAC | 433 | 14126 | GUAAACUAUGAUCAUUGCA | 1700 |
| 14109 | GCAAUGAUCAUAGUUUACC | 434 | 14109 | GCAAUGAUCAUAGUUUACC | 434 | 14127 | GGUAAACUAUGAUCAUUGC | 1701 |
| 14110 | CAAUGAUCAUAGUUUACCU | 435 | 14110 | CAAUGAUCAUAGUUUACCU | 435 | 14128 | AGGUAAACUAUGAUCAUUG | 1702 |
| 14111 | AAUGAUCAUAGUUUACCUA | 436 | 14111 | AAUGAUCAUAGUUUACCUA | 436 | 14129 | UAGGUAAACUAUGAUCAUU | 1703 |
| 14112 | AUGAUCAUAGUUUACCUAU | 437 | 14112 | AUGAUCAUAGUUUACCUAU | 437 | 14130 | AUAGGUAAACUAUGAUCAU | 1704 |
| 14113 | UGAUCAUAGUUUACCUAUU | 438 | 14113 | UGAUCAUAGUUUACCUAUU | 438 | 14131 | AAUAGGUAAACUAUGAUCA | 1705 |
| 14114 | GAUCAUAGUUUACCUAUUG | 439 | 14114 | GAUCAUAGUUUACCUAUUG | 439 | 14132 | CAAUAGGUAAACUAUGAUC | 1706 |
| 14115 | AUCAUAGUUUACCUAUUGA | 440 | 14115 | AUCAUAGUUUACCUAUUGA | 440 | 14133 | UCAAUAGGUAAACUAUGAU | 1707 |
| 1191 | CUGUCAUCCAGCAAAUACA | 441 | 1191 | CUGUCAUCCAGCAAAUACA | 441 | 1209 | UGUAUUUGCUGGAUGACAG | 1708 |
| 1192 | UGUCAUCCAGCAAAUACAC | 442 | 1192 | UGUCAUCCAGCAAAUACAC | 442 | 1210 | GUGUAUUUGCUGGAUGACA | 1709 |
| 4792 | UUCUGGCAAUGAUAAUCUC | 443 | 4792 | UUCUGGCAAUGAUAAUCUC | 443 | 4810 | GAGAUUAUCAUUGCCAGAA | 1710 |
| 4793 | UCUGGCAAUGAUAAUCUCA | 444 | 4793 | UCUGGCAAUGAUAAUCUCA | 444 | 4811 | UGAGAUUAUCAUUGCCAGA | 1711 |
| 4794 | CUGGCAAUGAUAAUCUCAA | 445 | 4794 | CUGGCAAUGAUAAUCUCAA | 445 | 4812 | UUGAGAUUAUCAUUGCCAG | 1712 |
| 10952 | CAUGCUCAAGCAGAUUAUU | 446 | 10952 | CAUGCUCAAGCAGAUUAUU | 446 | 10970 | AAUAAUCUGCUUGAGCAUG | 1713 |
| 10953 | AUGCUCAAGCAGAUUAUUU | 447 | 10953 | AUGCUCAAGCAGAUUAUUU | 447 | 10971 | AAAUAAUCUGCUUGAGCAU | 1714 |
| 10954 | UGCUCAAGCAGAUUAUUUG | 448 | 10954 | UGCUCAAGCAGAUUAUUUG | 448 | 10972 | CAAAUAAUCUGCUUGAGCA | 1715 |
| 11293 | AAAUCAUGCAUUAUGUAAC | 449 | 11293 | AAAUCAUGCAUUAUGUAAC | 449 | 11311 | GUUACAUAAUGCAUGAUUU | 1716 |
| 11294 | AAUCAUGCAUUAUGUAACA | 450 | 11294 | AAUCAUGCAUUAUGUAACA | 450 | 11312 | UGUUACAUAAUGCAUGAUU | 1717 |

TABLE II-continued

RSV siNA AND TARGET SEQUENCES

| Pos | Seq | Seq ID | UPos | Upper seq | Seq ID | LPos | Lower seq | Seq ID |
|---|---|---|---|---|---|---|---|---|
| 11295 | AUCAUGCAUUAUGUAACAA | 451 | 11295 | AUCAUGCAUUAUGUAACAA | 451 | 11313 | UUGUUACAUAAUGCAUGAU | 1718 |
| 11296 | UCAUGCAUUAUGUAACAAU | 452 | 11296 | UCAUGCAUUAUGUAACAAU | 452 | 11314 | AUUGUUACAUAAUGCAUGA | 1719 |
| 11297 | CAUGCAUUAUGUAACAAUA | 453 | 11297 | CAUGCAUUAUGUAACAAUA | 453 | 11315 | UAUUGUUACAUAAUGCAUG | 1720 |
| 11298 | AUGCAUUAUGUAACAAUAA | 454 | 11298 | AUGCAUUAUGUAACAAUAA | 454 | 11316 | UUAUUGUUACAUAAUGCAU | 1721 |
| 3045 | ACAAUGAUCUAUCACUUGA | 455 | 3045 | ACAAUGAUCUAUCACUUGA | 455 | 3063 | UCAAGUGAUAGAUCAUUGU | 1722 |
| 11001 | AUAAGAGUAUGCAGGCAU | 456 | 11001 | AUAAGAGUAUGCAGGCAU | 456 | 11019 | AUGCCUGCAUACUCUUUAU | 1723 |
| 11793 | AUAUUAUGCAAAAUAUAGA | 457 | 11793 | AUAUUAUGCAAAAUAUAGA | 457 | 11811 | UCUAUAUUUUGCAUAAUAU | 1724 |
| 13449 | AACACAAAUUCAAUGAUGA | 458 | 13449 | AACACAAAUUCAAUGAUGA | 458 | 13467 | UCAUCAUUGAAUUUGUGUU | 1725 |
| 57 | AAUUUGAUAAGUACCACUU | 459 | 57 | AAUUUGAUAAGUACCACUU | 459 | 75 | AAGUGGUACUUAUCAAAUU | 1726 |
| 75 | UAAAUUUAACUCCCUUGGU | 460 | 75 | UAAAUUUAACUCCCUUGGU | 460 | 93 | ACCAAGGGAGUUAAAUUUA | 1727 |
| 93 | UUAGAGAUGGGCAGCAAUU | 461 | 93 | UUAGAGAUGGGCAGCAAUU | 461 | 111 | AAUUGCUGCCCAUCUCUAA | 1728 |
| 129 | GUUAGAUUACAAAAUUUGU | 462 | 129 | GUUAGAUUACAAAAUUUGU | 462 | 147 | ACAAAUUUUGUAAUCUAAC | 1729 |
| 147 | UUUGACAAUGAUGAAGUAG | 463 | 147 | UUUGACAAUGAUGAAGUAG | 463 | 165 | CUACUUCAUCAUUGUCAAA | 1730 |
| 219 | UUGGCUAAGGCAGUGAUAC | 464 | 219 | UUGGCUAAGGCAGUGAUAC | 464 | 237 | GUAUCACUGCCUUAGCCAA | 1731 |
| 237 | CAUACAAUCAAAUUGAAUG | 465 | 237 | CAUACAAUCAAAUUGAAUG | 465 | 255 | CAUUCAAUUUGAUUGUAUG | 1732 |
| 273 | GUUAUUACAAGUAGUGAUA | 466 | 273 | GUUAUUACAAGUAGUGAUA | 466 | 291 | UAUCACUACUUGUAAUAAC | 1733 |
| 363 | AUAUGGGAAAUGAUGGAAU | 467 | 363 | AUAUGGGAAAUGAUGGAAU | 467 | 381 | AUUCCAUCAUUUCCCAUAU | 1734 |
| 417 | GACAAUUGUGAAAUUAAAU | 468 | 417 | GACAAUUGUGAAAUUAAAU | 468 | 435 | AUUUAAUUUCACAAUUGUC | 1735 |
| 435 | UUCUCCAAAAAACUAAGUG | 469 | 435 | UUCUCCAAAAAACUAAGUG | 469 | 453 | CACUUAGUUUUUGGAGAA | 1736 |
| 453 | GAUUCAACAAUGACCAAUU | 470 | 453 | GAUUCAACAAUGACCAAUU | 470 | 471 | AAUUGGUCAUUGUUGAAUC | 1737 |
| 471 | UAUAUGAAUCAAUUAUCUG | 471 | 471 | UAUAUGAAUCAAUUAUCUG | 471 | 489 | CAGAUAAUUGAUUCAUAUA | 1738 |
| 489 | GAAUUACUUGGAUUUGAUC | 472 | 489 | GAAUUACUUGGAUUUGAUC | 472 | 507 | GAUCAAAUCCAAGUAAUUC | 1739 |
| 507 | CUUAAUCCAUAAAUUAUAA | 473 | 507 | CUUAAUCCAUAAAUUAUAA | 473 | 525 | UUAUAAUUUAUGGAUUAAG | 1740 |
| 561 | AUUAGUUAAUAUAAAACUU | 474 | 561 | AUUAGUUAAUAUAAAACUU | 474 | 579 | AAGUUUUAUAUUAACUAAU | 1741 |
| 777 | AAAACUUGAUGAAAGACAG | 475 | 777 | AAAACUUGAUGAAAGACAG | 475 | 795 | CUGUCUUUCAUCAAGUUUU | 1742 |
| 795 | GGCCACAUUUACAUUCCUG | 476 | 795 | GGCCACAUUUACAUUCCUG | 476 | 813 | CAGGAAUGUAAAUGUGGCC | 1743 |
| 813 | GGUCAACUAUGAAAUGAAA | 477 | 813 | GGUCAACUAUGAAAUGAAA | 477 | 831 | UUUCAUUUCAUAGUUGACC | 1744 |
| 867 | AUAUACUGAAUACAACACA | 478 | 867 | AUAUACUGAAUACAACACA | 478 | 885 | UGUGUUGUAUUCAGUAUAU | 1745 |
| 921 | UCAUGAUGGGUUCUUAGAA | 479 | 921 | UCAUGAUGGGUUCUUAGAA | 479 | 939 | UUCUAAGAACCCAUCAUGA | 1746 |
| 939 | AUGCAUUGGCAUUAAGCCU | 480 | 939 | AUGCAUUGGCAUUAAGCCU | 480 | 957 | AGGCUUAAUGCCAAUGCAU | 1747 |
| 975 | AAUAUACAAGUAUGAUCUC | 481 | 975 | AAUAUACAAGUAUGAUCUC | 481 | 993 | GAGAUCAUACUUGUAUAUU | 1748 |
| 1155 | GUCAAGUUGAAUGAUACAC | 482 | 1155 | GUCAAGUUGAAUGAUACAC | 482 | 1173 | GUGUAUCAUUCAACUUGAC | 1749 |
| 1173 | CUCAACAAAGAUCAACUUC | 483 | 1173 | CUCAACAAAGAUCAACUUC | 483 | 1191 | GAAGUUGAUCUUUGUUGAG | 1750 |
| 1209 | ACCAUCCAACGGAGCACAG | 484 | 1209 | ACCAUCCAACGGAGCACAG | 484 | 1227 | CUGUGCUCCGUUGGAUGGU | 1751 |
| 1227 | GGAGAUAGUAUUGAUACUC | 485 | 1227 | GGAGAUAGUAUUGAUACUC | 485 | 1245 | GAGUAUCAAUACUAUCUCC | 1752 |
| 1245 | CCUAAUUAUGAUGUGCAGA | 486 | 1245 | CCUAAUUAUGAUGUGCAGA | 486 | 1263 | UCUGCACAUCAUAAUUAGG | 1753 |
| 1263 | AAACACAUCAAUAAGUUAU | 487 | 1263 | AAACACAUCAAUAAGUUAU | 487 | 1281 | AUAACUUAUUGAUGUGUUU | 1754 |
| 1281 | UGUGGCAUGUUAUUAAUCA | 488 | 1281 | UGUGGCAUGUUAUUAAUCA | 488 | 1299 | UGAUUAAUAACAUGCCACA | 1755 |

TABLE II-continued

RSV siNA AND TARGET SEQUENCES

| Pos | Seq | Seq ID | UPos | Upper seq | Seq ID | LPos | Lower seq | Seq ID |
|---|---|---|---|---|---|---|---|---|
| 1299 | ACAGAAGAUGCUAAUCAUA | 489 | 1299 | ACAGAAGAUGCUAAUCAUA | 489 | 1317 | UAUGAUUAGCAUCUUCUGU | 1756 |
| 1317 | AAAUUCACUGGGUUAAUAG | 490 | 1317 | AAAUUCACUGGGUUAAUAG | 490 | 1335 | CUAUUAACCCAGUGAAUUU | 1757 |
| 1335 | GGUAUGUUAUAUGCUAUGU | 491 | 1335 | GGUAUGUUAUAUGCUAUGU | 491 | 1353 | ACAUAGCAUAUAACAUACC | 1758 |
| 1371 | GACACCAUAAAAAUACUCA | 492 | 1371 | GACACCAUAAAAAUACUCA | 492 | 1389 | UGAGUAUUUUUAUGGUGUC | 1759 |
| 1389 | AGAGAUGCGGGAUAUCAUG | 493 | 1389 | AGAGAUGCGGGAUAUCAUG | 493 | 1407 | CAUGAUAUCCCGCAUCUCU | 1760 |
| 1425 | GAUGUAACAACACAUCGUC | 494 | 1425 | GAUGUAACAACACAUCGUC | 494 | 1443 | GACGAUGUGUUGUUACAUC | 1761 |
| 1461 | GAAAUGAAAUUUGAAGUGU | 495 | 1461 | GAAAUGAAAUUUGAAGUGU | 495 | 1479 | ACACUUCAAAUUUCAUUUC | 1762 |
| 1497 | ACAACUGAAAUUCAAAUCA | 496 | 1497 | ACAACUGAAAUUCAAAUCA | 496 | 1515 | UGAUUUGAAUUUCAGUUGU | 1763 |
| 1515 | AACAUUGAGAUAGAAUCUA | 497 | 1515 | AACAUUGAGAUAGAAUCUA | 497 | 1533 | UAGAUUCUAUCUCAAUGUU | 1764 |
| 1551 | AUGCUAAAAGAAAUGGGAG | 498 | 1551 | AUGCUAAAAGAAAUGGGAG | 498 | 1569 | CUCCCAUUUCUUUUAGCAU | 1765 |
| 1569 | GAGGUAGCUCCAGAAUACA | 499 | 1569 | GAGGUAGCUCCAGAAUACA | 499 | 1587 | UGUAUUCUGGAGCUACCUC | 1766 |
| 1605 | UGUGGGAUGAUAAUAUUAU | 500 | 1605 | UGUGGGAUGAUAAUAUUAU | 500 | 1623 | AUAAUAUUAUCAUCCCACA | 1767 |
| 1695 | GCUAAUAAUGUCCUAAAAA | 501 | 1695 | GCUAAUAAUGUCCUAAAAA | 501 | 1713 | UUUUUAGGACAUUAUUAGC | 1768 |
| 1731 | AAAGGCUUACUACCCAAGG | 502 | 1731 | AAAGGCUUACUACCCAAGG | 502 | 1749 | CCUUGGGUAGUAAGCCUUU | 1769 |
| 1803 | GUUUUUGUUCAUUUUGGUA | 503 | 1803 | GUUUUUGUUCAUUUUGGUA | 503 | 1821 | UACCAAAAUGAACAAAAAC | 1770 |
| 1839 | AGAGGUGGCAGUAGAGUUG | 504 | 1839 | AGAGGUGGCAGUAGAGUUG | 504 | 1857 | CAACUCUACUGCCACCUCU | 1771 |
| 1965 | AGUGUGCAAGCAGAAAUGG | 505 | 1965 | AGUGUGCAAGCAGAAAUGG | 505 | 1983 | CCAUUUCUGCUUGCACACU | 1772 |
| 2001 | UAUGAAUAUGCCCAAAAAU | 506 | 2001 | UAUGAAUAUGCCCAAAAAU | 506 | 2019 | AUUUUUGGGCAUAUUCAUA | 1773 |
| 2055 | AACCCAAAAGCAUCAUUAU | 507 | 2055 | AACCCAAAAGCAUCAUUAU | 507 | 2073 | AUAAUGAUGCUUUUGGGUU | 1774 |
| 2109 | GUAUUAGGCAAUGCUGCUG | 508 | 2109 | GUAUUAGGCAAUGCUGCUG | 508 | 2127 | CAGCAGCAUUGCCUAAUAC | 1775 |
| 2127 | GGCCUAGGCAUAAUGGGAG | 509 | 2127 | GGCCUAGGCAUAAUGGGAG | 509 | 2145 | CUCCCAUUAUGCCUAGGCC | 1776 |
| 2163 | AGGAAUCAAGAUCUAUAUG | 510 | 2163 | AGGAAUCAAGAUCUAUAUG | 510 | 2181 | CAUAUAGAUCUUGAUUCCU | 1777 |
| 2199 | GCUGAACAACUCAAAGAAA | 511 | 2199 | GCUGAACAACUCAAAGAAA | 511 | 2217 | UUUCUUUGAGUUGUUCAGC | 1778 |
| 2217 | AAUGGUGUGAUUAACUACA | 512 | 2217 | AAUGGUGUGAUUAACUACA | 512 | 2235 | UGUAGUUAAUCACACCAUU | 1779 |
| 2253 | GCAGAAGAACUAGAGGCUA | 513 | 2253 | GCAGAAGAACUAGAGGCUA | 513 | 2271 | UAGCCUCUAGUUCUUCUGC | 1780 |
| 2271 | AUCAAACAUCAGCUUAAUC | 514 | 2271 | AUCAAACAUCAGCUUAAUC | 514 | 2289 | GAUUAAGCUGAUGUUUGAU | 1781 |
| 2289 | CCAAAAGAUAAUGAUGUAG | 515 | 2289 | CCAAAAGAUAAUGAUGUAG | 515 | 2307 | CUACAUCAUUAUCUUUUGG | 1782 |
| 2307 | GAGCUUUGAGUUAAUAAAA | 516 | 2307 | GAGCUUUGAGUUAAUAAAA | 516 | 2325 | UUUUAUUAACUCAAAGCUC | 1783 |
| 2361 | CUCCUGAAUUCCAUGGAGA | 517 | 2361 | CUCCUGAAUUCCAUGGAGA | 517 | 2379 | UCUCCAUGGAAUUCAGGAG | 1784 |
| 2415 | CAAUAAAGGGCAAAUUCAC | 518 | 2415 | CAAUAAAGGGCAAAUUCAC | 518 | 2433 | GUGAAUUUGCCCUUUAUUG | 1785 |
| 2451 | AGAAAAAGAUAGUAUCAU | 519 | 2451 | AGAAAAAGAUAGUAUCAU | 519 | 2469 | AUGAUACUAUCUUUUUCU | 1786 |
| 2469 | UAUCUGUCAACUCAAUAGA | 520 | 2469 | UAUCUGUCAACUCAAUAGA | 520 | 2487 | UCUAUUGAGUUGACAGAUA | 1787 |
| 2505 | AAAGCCCUAUAACAUCAAA | 521 | 2505 | AAAGCCCUAUAACAUCAAA | 521 | 2523 | UUUGAUGUUAUAGGGCUUU | 1788 |
| 2541 | CAACAAAUGAGACAGAUGA | 522 | 2541 | CAACAAAUGAGACAGAUGA | 522 | 2559 | UCAUCUGUCUCAUUUGUUG | 1789 |
| 2577 | CCAAUUAUCAAAGAAAACC | 523 | 2577 | CCAAUUAUCAAAGAAAACC | 523 | 2595 | GGUUUUCUUUGAUAAUUGG | 1790 |
| 2595 | CUCUAGUAAGUUUCAAAGA | 524 | 2595 | CUCUAGUAAGUUUCAAAGA | 524 | 2613 | UCUUUGAAACUUACUAGAG | 1791 |
| 2649 | UAUACAAAGAAACCAUAGA | 525 | 2649 | UAUACAAAGAAACCAUAGA | 525 | 2667 | UCUAUGGUUUCUUUGUAUA | 1792 |

TABLE II-continued

RSV siNA AND TARGET SEQUENCES

| Pos | Seq | Seq ID | UPos | Upper seq | Seq ID | LPos | Lower seq | Seq ID |
|---|---|---|---|---|---|---|---|---|
| 2757 | GGAUUGAUGAAAAAUUAAG | 526 | 2757 | GGAUUGAUGAAAAAUUAAG | 526 | 2775 | CUUAAUUUUUCAUCAAUCC | 1793 |
| 2775 | GUGAAAUACUAGGAAUGCU | 527 | 2775 | GUGAAAUACUAGGAAUGCU | 527 | 2793 | AGCAUUCCUAGUAUUUCAC | 1794 |
| 2847 | GAGAUGCCAUGGUUGGUUU | 528 | 2847 | GAGAUGCCAUGGUUGGUUU | 528 | 2865 | AAACCAACCAUGGCAUCUC | 1795 |
| 2883 | AAAAAAUCAGAACUGAAGC | 529 | 2883 | AAAAAAUCAGAACUGAAGC | 529 | 2901 | GCUUCAGUUCUGAUUUUUU | 1796 |
| 2901 | CAUUAAUGACCAAUGACAG | 530 | 2901 | CAUUAAUGACCAAUGACAG | 530 | 2919 | CUGUCAUUGGUCAUUAAUG | 1797 |
| 2937 | GACUCAGGAAUGAGGAAAG | 531 | 2937 | GACUCAGGAAUGAGGAAAG | 531 | 2955 | CUUUCCUCAUUCCUGAGUC | 1798 |
| 2955 | GUGAAAAGAUGGCAAAAGA | 532 | 2955 | GUGAAAAGAUGGCAAAAGA | 532 | 2973 | UCUUUUGCCAUCUUUUCAC | 1799 |
| 2973 | ACACAUCAGAUGAAGUGUC | 533 | 2973 | ACACAUCAGAUGAAGUGUC | 533 | 2991 | GACACUUCAUCUGAUGUGU | 1800 |
| 2991 | CUCUCAAUCCAACAUCAGA | 534 | 2991 | CUCUCAAUCCAACAUCAGA | 534 | 3009 | UCUGAUGUUGGAUUGAGAG | 1801 |
| 3027 | UGGAAGGGAAUGAUAGUGA | 535 | 3027 | UGGAAGGGAAUGAUAGUGA | 535 | 3045 | UCACUAUCAUUCCCUUCCA | 1802 |
| 3279 | CUGCUGUUCAAUACAAUGU | 536 | 3279 | CUGCUGUUCAAUACAAUGU | 536 | 3297 | ACAUUGUAUUGAACAGCAG | 1803 |
| 3315 | ACCCUGCAUCACUUACAAU | 537 | 3315 | ACCCUGCAUCACUUACAAU | 537 | 3333 | AUUGUAAGUGAUGCAGGGU | 1804 |
| 3333 | UAUGGGUGCCCAUGUUCCA | 538 | 3333 | UAUGGGUGCCCAUGUUCCA | 538 | 3351 | UGGAACAUGGGCACCCAUA | 1805 |
| 3369 | AUUUACUUAUAAAGAACU | 539 | 3369 | AUUUACUUAUAAAGAACU | 539 | 3387 | AGUUCUUUUAUAAGUAAAU | 1806 |
| 3387 | UAGCUAAUGUCAACAUACU | 540 | 3387 | UAGCUAAUGUCAACAUACU | 540 | 3405 | AGUAUGUUGACAUUAGCUA | 1807 |
| 3405 | UAGUGAAACAAAUAUCCAC | 541 | 3405 | UAGUGAAACAAAUAUCCAC | 541 | 3423 | GUGGAUAUUUGUUUCACUA | 1808 |
| 3441 | UAAGAGUCAUGAUAAACUC | 542 | 3441 | UAAGAGUCAUGAUAAACUC | 542 | 3459 | GAGUUUAUCAUGACUCUUA | 1809 |
| 3477 | CACAAAUGCCCAGCAAAUU | 543 | 3477 | CACAAAUGCCCAGCAAAUU | 543 | 3495 | AAUUUGCUGGGCAUUUGUG | 1810 |
| 3513 | UGUCCUUGGAUGAAAGAAG | 544 | 3513 | UGUCCUUGGAUGAAAGAAG | 544 | 3531 | CUUCUUUCAUCCAAGGACA | 1811 |
| 3549 | UAACCACACCCUGUGAAAU | 545 | 3549 | UAACCACACCCUGUGAAAU | 545 | 3567 | AUUUCACAGGGUGUGGUUA | 1812 |
| 3567 | UCAAGGCAUGUAGUCUAAC | 546 | 3567 | UCAAGGCAUGUAGUCUAAC | 546 | 3585 | GUUAGACUACAUGCCUUGA | 1813 |
| 3585 | CAUGCCUAAAAUCAAAAAA | 547 | 3585 | CAUGCCUAAAAUCAAAAAA | 547 | 3603 | UUUUUUGAUUUUAGGCAUG | 1814 |
| 3693 | CAUCAAAAAAGUCAUAAU | 548 | 3693 | CAUCAAAAAAGUCAUAAU | 548 | 3711 | AUUAUGACUUUUUUGAUG | 1815 |
| 3711 | UACCAACAUACCUAAGAUC | 549 | 3711 | UACCAACAUACCUAAGAUC | 549 | 3729 | GAUCUUAGGUAUGUUGGUA | 1816 |
| 3729 | CCAUCAGUGUCAGAAAUAA | 550 | 3729 | CCAUCAGUGUCAGAAAUAA | 550 | 3747 | UUAUUUCUGACACUGAUGG | 1817 |
| 3747 | AAGAUCUGAACACACUUGA | 551 | 3747 | AAGAUCUGAACACACUUGA | 551 | 3765 | UCAAGUGUGUUCAGAUCUU | 1818 |
| 3765 | AAAAUAUAACAACCACUGA | 552 | 3765 | AAAAUAUAACAACCACUGA | 552 | 3783 | UCAGUGGUUGUUAUAUUUU | 1819 |
| 3801 | CAAAUGCAAAAUCAUCCC | 553 | 3801 | CAAAUGCAAAAUCAUCCC | 553 | 3819 | GGGAUGAUUUUGCAUUUG | 1820 |
| 3837 | UAGUCAUCACAGUGACUGA | 554 | 3837 | UAGUCAUCACAGUGACUGA | 554 | 3855 | UCAGUCACUGUGAUGACUA | 1821 |
| 3855 | ACAACAAAGGAGCAUUCAA | 555 | 3855 | ACAACAAAGGAGCAUUCAA | 555 | 3873 | UUGAAUGCUCCUUUGUUGU | 1822 |
| 3909 | UUGGAGCUUACCUAGAAAA | 556 | 3909 | UUGGAGCUUACCUAGAAAA | 556 | 3927 | UUUUCUAGGUAAGCUCCAA | 1823 |
| 3927 | AAGAAAGUAUAUUAUGU | 557 | 3927 | AAGAAAGUAUAUUAUGU | 557 | 3945 | ACAUAAUAUAUACUUUCUU | 1824 |
| 3963 | ACACAGCUACACGAUUUGC | 558 | 3963 | ACACAGCUACACGAUUUGC | 558 | 3981 | GCAAAUCGUGUAGCUGUGU | 1825 |
| 3981 | CAAUCAAACCCAUGGAAGA | 559 | 3981 | CAAUCAAACCCAUGGAAGA | 559 | 3999 | UCUUCCAUGGGUUUGAUUG | 1826 |
| 4035 | UACAAACUUUCUACCUACA | 560 | 4035 | UACAAACUUUCUACCUACA | 560 | 4053 | UGUAGGUAGAAAGUUUGUA | 1827 |
| 4125 | CAGAUCAUCCCAAGUCAUU | 561 | 4125 | CAGAUCAUCCCAAGUCAUU | 561 | 4143 | AAUGACUUGGGAUGAUCUG | 1828 |
| 4215 | CCAACUAAUCACAAUAUCU | 562 | 4215 | CCAACUAAUCACAAUAUCU | 562 | 4233 | AGAUAUUGUGAUUAGUUGG | 1829 |
| 4269 | AACCAAUGGAAAAUACAUC | 563 | 4269 | AACCAAUGGAAAAUACAUC | 563 | 4287 | GAUGUAUUUUCCAUUGGUU | 1830 |

TABLE II-continued

RSV siNA AND TARGET SEQUENCES

| Pos | Seq | Seq ID | UPos | Upper seq | Seq ID | LPos | Lower seq | Seq ID |
|---|---|---|---|---|---|---|---|---|
| 4287 | CCAUAACAAUAGAAUUCUC | 564 | 4287 | CCAUAACAAUAGAAUUCUC | 564 | 4305 | GAGAAUUCUAUUGUUAUGG | 1831 |
| 4305 | CAAGCAAAUUCUGGCCUUA | 565 | 4305 | CAAGCAAAUUCUGGCCUUA | 565 | 4323 | UAAGGCCAGAAUUUGCUUG | 1832 |
| 4323 | ACUUUACACUAAUACACAU | 566 | 4323 | ACUUUACACUAAUACACAU | 566 | 4341 | AUGUGUAUUAGUGUAAAGU | 1833 |
| 4359 | CUUUGCUAAUCAUAAUCUC | 567 | 4359 | CUUUGCUAAUCAUAAUCUC | 567 | 4377 | GAGAUUAUGAUUAGCAAAG | 1834 |
| 4413 | AUAACGUAUUCCAUAACAA | 568 | 4413 | AUAACGUAUUCCAUAACAA | 568 | 4431 | UUGUUAUGGAAUACGUUAU | 1835 |
| 4647 | GCAAAUGCAAACAUGUCCA | 569 | 4647 | GCAAAUGCAAACAUGUCCA | 569 | 4665 | UGGACAUGUUUGCAUUUGC | 1836 |
| 4665 | AAAAACAAGGACCAACGCA | 570 | 4665 | AAAAACAAGGACCAACGCA | 570 | 4683 | UGCGUUGGUCCUUGUUUUU | 1837 |
| 4773 | GCACAAAUCACAUUAUCCA | 571 | 4773 | GCACAAAUCACAUUAUCCA | 571 | 4791 | UGGAUAAUGUGAUUUGUGC | 1838 |
| 4791 | AUUCUGGCAAUGAUAAUCU | 572 | 4791 | AUUCUGGCAAUGAUAAUCU | 572 | 4809 | AGAUUAUCAUUGCCAGAAU | 1839 |
| 4845 | GCCUCGGCAAACCACAAAG | 573 | 4845 | GCCUCGGCAAACCACAAAG | 573 | 4863 | CUUUGUGGUUUGCCGAGGC | 1840 |
| 4881 | AUCAUACAAGAUGCAACAA | 574 | 4881 | AUCAUACAAGAUGCAACAA | 574 | 4899 | UUGUUGCAUCUUGUAUGAU | 1841 |
| 4899 | AGCCAGAUCAAGAACACAA | 575 | 4899 | AGCCAGAUCAAGAACACAA | 575 | 4917 | UUGUGUUCUUGAUCUGGCU | 1842 |
| 5133 | CCCAAUAAUGAUUUUCACU | 576 | 5133 | CCCAAUAAUGAUUUUCACU | 576 | 5151 | AGUGAAAAUCAUUAUUGGG | 1843 |
| 5187 | AGCAACAAUCCAACCUGCU | 577 | 5187 | AGCAACAAUCCAACCUGCU | 577 | 5205 | AGCAGGUUGGAUUGUUGCU | 1844 |
| 5367 | AACACCACCAAAACAAACA | 578 | 5367 | AACACCACCAAAACAAACA | 578 | 5385 | UGUUUGUUUUGGUGGUGUU | 1845 |
| 5619 | GGGGCAAAUAACAAUGGAG | 579 | 5619 | GGGGCAAAUAACAAUGGAG | 579 | 5637 | CUCCAUUGUUAUUUGCCCC | 1846 |
| 5709 | AAACAUCACUGAAGAAUUU | 580 | 5709 | AAACAUCACUGAAGAAUUU | 580 | 5727 | AAAUUCUUCAGUGAUGUUU | 1847 |
| 5799 | UAUAACUAUAGAAUUAAGU | 581 | 5799 | UAUAACUAUAGAAUUAAGU | 581 | 5817 | ACUUAAUUCUAUAGUUAUA | 1848 |
| 5907 | AUUGCAGUUGCUCAUGCAA | 582 | 5907 | AUUGCAGUUGCUCAUGCAA | 582 | 5925 | UUGCAUGAGCAACUGCAAU | 1849 |
| 5943 | CAAUCGAGCCAGAAGAGAA | 583 | 5943 | CAAUCGAGCCAGAAGAGAA | 583 | 5961 | UUCUCUUCUGGCUCGAUUG | 1850 |
| 5961 | ACUACCAAGGUUUAUGAAU | 584 | 5961 | ACUACCAAGGUUUAUGAAU | 584 | 5979 | AUUCAUAAACCUUGGUAGU | 1851 |
| 6015 | AUUAAGCAAGAAAAGGAAA | 585 | 6015 | AUUAAGCAAGAAAAGGAAA | 585 | 6033 | UUUCCUUUUCUUGCUUAAU | 1852 |
| 6051 | UUUGUUAGGUGUUGGAUCU | 586 | 6051 | UUUGUUAGGUGUUGGAUCU | 586 | 6069 | AGAUCCAACACCUAACAAA | 1853 |
| 6087 | UGCUGUAUCUAAGGUCCUG | 587 | 6087 | UGCUGUAUCUAAGGUCCUG | 587 | 6105 | CAGGACCUUAGAUACAGCA | 1854 |
| 6141 | UCUACUAUCCACAAACAAG | 588 | 6141 | UCUACUAUCCACAAACAAG | 588 | 6159 | CUUGUUUGUGGAUAGUAGA | 1855 |
| 6195 | AACCAGCAAAGUGUUAGAC | 589 | 6195 | AACCAGCAAAGUGUUAGAC | 589 | 6213 | GUCUAACACUUUGCUGGUU | 1856 |
| 6213 | CCUCAAAAACUAUAUAGAU | 590 | 6213 | CCUCAAAAACUAUAUAGAU | 590 | 6231 | AUCUAUAUAGUUUUUGAGG | 1857 |
| 6303 | ACAAAAGAACAACAGACUA | 591 | 6303 | ACAAAAGAACAACAGACUA | 591 | 6321 | UAGUCUGUUGUUCUUUUGU | 1858 |
| 6321 | ACUAGAGAUUACCAGGGAA | 592 | 6321 | ACUAGAGAUUACCAGGGAA | 592 | 6339 | UUCCCUGGUAAUCUCUAGU | 1859 |
| 6411 | AAUCAAUGAUAUGCCUAUA | 593 | 6411 | AAUCAAUGAUAUGCCUAUA | 593 | 6429 | UAUAGGCAUAUCAUUGAUU | 1860 |
| 6429 | AACAAAUGAUCAGAAAAAG | 594 | 6429 | AACAAAUGAUCAGAAAAAG | 594 | 6447 | CUUUUUCUGAUCAUUUGUU | 1861 |
| 6447 | GUUAAUGUCCAACAAUGUU | 595 | 6447 | GUUAAUGUCCAACAAUGUU | 595 | 6465 | AACAUUGUUGGACAUUAAC | 1862 |
| 6465 | UCAAAUAGUUAGACAGCAA | 596 | 6465 | UCAAAUAGUUAGACAGCAA | 596 | 6483 | UUGCUGUCUAACUAUUUGA | 1863 |
| 6483 | AAGUUACUCUAUCAUGUCC | 597 | 6483 | AAGUUACUCUAUCAUGUCC | 597 | 6501 | GGACAUGAUAGAGUAACUU | 1864 |
| 6519 | CUUAGCAUAUGUAGUACAA | 598 | 6519 | CUUAGCAUAUGUAGUACAA | 598 | 6537 | UUGUACUACAUAUGCUAAG | 1865 |
| 6591 | UCUAUGUACAACCAACACA | 599 | 6591 | UCUAUGUACAACCAACACA | 599 | 6609 | UGUGUUGGUUGUACAUAGA | 1866 |
| 6645 | CAGAGGAUGGUACUGUGAC | 600 | 6645 | CAGAGGAUGGUACUGUGAC | 600 | 6663 | GUCACAGUACCAUCCUCUG | 1867 |

TABLE II-continued

RSV siNA AND TARGET SEQUENCES

| Pos | Seq | Seq ID | UPos | Upper seq | Seq ID | LPos | Lower seq | Seq ID |
|---|---|---|---|---|---|---|---|---|
| 6663 | CAAUGCAGGAUCAGUAUCU | 601 | 6663 | CAAUGCAGGAUCAGUAUCU | 601 | 6681 | AGAUACUGAUCCUGCAUUG | 1868 |
| 6735 | CACAAUGAACAGUUUAACA | 602 | 6735 | CACAAUGAACAGUUUAACA | 602 | 6753 | UGUUAAACUGUUCAUUGUG | 1869 |
| 6753 | AUUACCAAGUGAAGUAAAU | 603 | 6753 | AUUACCAAGUGAAGUAAAU | 603 | 6771 | AUUUACUUCACUUGGUAAU | 1870 |
| 6825 | AAAAACAGAUGUAAGCAGC | 604 | 6825 | AAAAACAGAUGUAAGCAGC | 604 | 6843 | GCUGCUUACAUCUGUUUUU | 1871 |
| 6843 | CUCCGUUAUCACAUCUCUA | 605 | 6843 | CUCCGUUAUCACAUCUCUA | 605 | 6861 | UAGAGAUGUGAUAACGGAG | 1872 |
| 6861 | AGGAGCCAUUGUGUCAUGC | 606 | 6861 | AGGAGCCAUUGUGUCAUGC | 606 | 6879 | GCAUGACACAAUGGCUCCU | 1873 |
| 6879 | CUAUGGCAAAACUAAAUGU | 607 | 6879 | CUAUGGCAAAACUAAAUGU | 607 | 6897 | ACAUUUAGUUUUGCCAUAG | 1874 |
| 6897 | UACAGCAUCCAAUAAAAAU | 608 | 6897 | UACAGCAUCCAAUAAAAAU | 608 | 6915 | AUUUUUAUUGGAUGCUGUA | 1875 |
| 6915 | UCGUGGAAUCAUAAAGACA | 609 | 6915 | UCGUGGAAUCAUAAAGACA | 609 | 6933 | UGUCUUUAUGAUUCCACGA | 1876 |
| 7041 | AGGUGAACCAAUAAUAAAU | 610 | 7041 | AGGUGAACCAAUAAUAAAU | 610 | 7059 | AUUUAUUAUUGGUUCACCU | 1877 |
| 7149 | UCGUAAAUCCGAUGAAUUA | 611 | 7149 | UCGUAAAUCCGAUGAAUUA | 611 | 7167 | UAAUUCAUCGGAUUUACGA | 1878 |
| 7203 | UAUCAUGAUAACUACUAUA | 612 | 7203 | UAUCAUGAUAACUACUAUA | 612 | 7221 | UAUAGUAGUUAUCAUGAUA | 1879 |
| 7221 | AAUUAUAGUGAUUAUAGUA | 613 | 7221 | AAUUAUAGUGAUUAUAGUA | 613 | 7239 | UACUAUAAUCACUAUAAUU | 1880 |
| 7239 | AAUAUUGUUAUCAUUAAUU | 614 | 7239 | AAUAUUGUUAUCAUUAAUU | 614 | 7257 | AAUUAAUGAUAACAAUAUU | 1881 |
| 7293 | CACACCAGUCACACUAAGC | 615 | 7293 | CACACCAGUCACACUAAGC | 615 | 7311 | GCUUAGUGUGACUGGUGUG | 1882 |
| 7329 | UAUAAAUAAUAUUGCAUUU | 616 | 7329 | UAUAAAUAAUAUUGCAUUU | 616 | 7347 | AAAUGCAAUAUUAUUUAUA | 1883 |
| 7365 | AGCACCUAAUCAUGUUCUU | 617 | 7365 | AGCACCUAAUCAUGUUCUU | 617 | 7383 | AAGAACAUGAUUAGGUGCU | 1884 |
| 7401 | GCUCAUAGACAACCCAUCU | 618 | 7401 | GCUCAUAGACAACCCAUCU | 618 | 7419 | AGAUGGGUUGUCUAUGAGC | 1885 |
| 7437 | AAAUCUGAACUUCAUCGAA | 619 | 7437 | AAAUCUGAACUUCAUCGAA | 619 | 7455 | UUCGAUGAAGUUCAGAUUU | 1886 |
| 7491 | AAGUAGAUUCCUAGUUUAU | 620 | 7491 | AAGUAGAUUCCUAGUUUAU | 620 | 7509 | AUAAACUAGGAAUCUACUU | 1887 |
| 7581 | ACGAAGGAAUCCUUGCAAA | 621 | 7581 | ACGAAGGAAUCCUUGCAAA | 621 | 7599 | UUUGCAAGGAUUCCUUCGU | 1888 |
| 7599 | AUUUGAAAUUCGAGGUCAU | 622 | 7599 | AUUUGAAAUUCGAGGUCAU | 622 | 7617 | AUGACCUCGAAUUUCAAAU | 1889 |
| 7653 | UUAUUUUGAAUGGCCACCC | 623 | 7653 | UUAUUUUGAAUGGCCACCC | 623 | 7671 | GGGUGGCCAUUCAAAAUAA | 1890 |
| 7689 | ACAAAACUUUAUGUUAAAC | 624 | 7689 | ACAAAACUUUAUGUUAAAC | 624 | 7707 | GUUUAACAUAAAGUUUUGU | 1891 |
| 7707 | CAGAAUACUUAAGUCUAUG | 625 | 7707 | CAGAAUACUUAAGUCUAUG | 625 | 7725 | CAUAGACUUAAGUAUUCUG | 1892 |
| 7761 | AGCUGCAGAGUUGGACAGA | 626 | 7761 | AGCUGCAGAGUUGGACAGA | 626 | 7779 | UCUGUCCAACUCUGCAGCU | 1893 |
| 7851 | ACAAUCAGCAUGUGUUGCC | 627 | 7851 | ACAAUCAGCAUGUGUUGCC | 627 | 7869 | GGCAACACAUGCUGAUUGU | 1894 |
| 7869 | CAUGAGCAAACUCCUCACU | 628 | 7869 | CAUGAGCAAACUCCUCACU | 628 | 7887 | AGUGAGGAGUUUGCUCAUG | 1895 |
| 7941 | ACCCAAGAUAAGAGUGUAC | 629 | 7941 | ACCCAAGAUAAGAGUGUAC | 629 | 7959 | GUACACUCUUAUCUUGGGU | 1896 |
| 7959 | CAAUACUGUCAUAUCAUAU | 630 | 7959 | CAAUACUGUCAUAUCAUAU | 630 | 7977 | AUAUGAUAUGACAGUAUUG | 1897 |
| 7977 | UAUUGAAAGCAACAGGAAA | 631 | 7977 | UAUUGAAAGCAACAGGAAA | 631 | 7995 | UUUCCUGUUGCUUUCAAUA | 1898 |
| 7995 | AAACAAUAAACAAACUAUC | 632 | 7995 | AAACAAUAAACAAACUAUC | 632 | 8013 | GAUAGUUUGUUUAUUGUUU | 1899 |
| 8013 | CCAUCUGUUAAAAGAUUG | 633 | 8013 | CCAUCUGUUAAAAGAUUG | 633 | 8031 | CAAUCUUUUAACAGAUGG | 1900 |
| 8031 | GCCAGCAGACGUAUUGAAG | 634 | 8031 | GCCAGCAGACGUAUUGAAG | 634 | 8049 | CUUCAAUACGUCUGCUGGC | 1901 |
| 8139 | CAAAAUAAUGAUACUACC | 635 | 8139 | CAAAAUAAUGAUACUACC | 635 | 8157 | GGUAGUAUCAUUAUUUUG | 1902 |
| 8157 | CUGACAAAUAUCCUUGUAG | 636 | 8157 | CUGACAAAUAUCCUUGUAG | 636 | 8175 | CUACAAGGAUAUUUGUCAG | 1903 |
| 8229 | AGAACACACUAUAUUUCAA | 637 | 8229 | AGAACACACUAUAUUUCAA | 637 | 8247 | UUGAAAUAUAGUGUGUUCU | 1904 |
| 8391 | UAGUGUCAUAACACUCAAU | 638 | 8391 | UAGUGUCAUAACACUCAAU | 638 | 8409 | AUUGAGUGUUAUGACACUA | 1905 |

TABLE II-continued

RSV siNA AND TARGET SEQUENCES

| Pos | Seq | Seq ID | UPos | Upper seq | Seq ID | LPos | Lower seq | Seq ID |
|---|---|---|---|---|---|---|---|---|
| 8481 | UUAAUGGAAAUUCUGCUAA | 639 | 8481 | UUAAUGGAAAUUCUGCUAA | 639 | 8499 | UUAGCAGAAUUUCCAUUAA | 1906 |
| 8553 | AUGCUUUAGGAAGUUACAU | 640 | 8553 | AUGCUUUAGGAAGUUACAU | 640 | 8571 | AUGUAACUUCCUAAAGCAU | 1907 |
| 8571 | UAUUCAAUGGUCCUUAUCU | 641 | 8571 | UAUUCAAUGGUCCUUAUCU | 641 | 8589 | AGAUAAGGACCAUUGAAUA | 1908 |
| 8589 | UCAAAAUGAUUAUACCAA | 642 | 8589 | UCAAAAUGAUUAUACCAA | 642 | 8607 | UUGGUAUAAUCAUUUUUGA | 1909 |
| 8607 | ACUUAAUUAGUAGACAAAA | 643 | 8607 | ACUUAAUUAGUAGACAAAA | 643 | 8625 | UUUUGUCUACUAAUUAAGU | 1910 |
| 8625 | AUCCAUUAAUAGAACACAU | 644 | 8625 | AUCCAUUAAUAGAACACAU | 644 | 8643 | AUGUGUUCUAUUAAUGGAU | 1911 |
| 8661 | AUAUAACACAGUCCUUAAU | 645 | 8661 | AUAUAACACAGUCCUUAAU | 645 | 8679 | AUUAAGGACUGUGUUAUAU | 1912 |
| 8733 | CAUUACUUAUGACAUACAA | 646 | 8733 | CAUUACUUAUGACAUACAA | 646 | 8751 | UUGUAUGUCAUAAGUAAUG | 1913 |
| 8787 | AUUUACUUAAAAAGAUAAU | 647 | 8787 | AUUUACUUAAAAAGAUAAU | 647 | 8805 | AUUAUCUUUUUAAGUAAAU | 1914 |
| 8805 | UAAGAAGAGCUAUAGAAAU | 648 | 8805 | UAAGAAGAGCUAUAGAAAU | 648 | 8823 | AUUUCUAUAGCUCUUCUUA | 1915 |
| 8841 | AUGCUAUAUUGAAUAAACU | 649 | 8841 | AUGCUAUAUUGAAUAAACU | 649 | 8859 | AGUUUAUUCAAUAUAGCAU | 1916 |
| 8877 | ACAAGAUUAAAUCCAACAA | 650 | 8877 | ACAAGAUUAAAUCCAACAA | 650 | 8895 | UUGUUGGAUUUAAUCUUGU | 1917 |
| 8931 | UAAUCAAAGAUGAUAUACU | 651 | 8931 | UAAUCAAAGAUGAUAUACU | 651 | 8949 | AGUAUAUCAUCUUUGAUUA | 1918 |
| 8967 | AUCAAUCUCAUCUUAAAGC | 652 | 8967 | AUCAAUCUCAUCUUAAAGC | 652 | 8985 | GCUUUAAGAUGAGAUUGAU | 1919 |
| 9075 | GGUUAAUACAUUGGUUUAA | 653 | 9075 | GGUUAAUACAUUGGUUUAA | 653 | 9093 | UUAAACCAAUGUAUUAACC | 1920 |
| 9111 | ACAACAUAUUAACACAGUA | 654 | 9111 | ACAACAUAUUAACACAGUA | 654 | 9129 | UACUGUGUUAAUAUGUUGU | 1921 |
| 9219 | GUAUAGUUUAUCAUAAGGA | 655 | 9219 | GUAUAGUUUAUCAUAAGGA | 655 | 9237 | UCCUUAUGAUAAACUAUAC | 1922 |
| 9237 | AACUCAAAAGAAUUACUGU | 656 | 9237 | AACUCAAAAGAAUUACUGU | 656 | 9255 | ACAGUAAUUCUUUUGAGUU | 1923 |
| 9255 | UGACAACCUAUAAUCAAUU | 657 | 9255 | UGACAACCUAUAAUCAAUU | 657 | 9273 | AAUUGAUUAUAGGUUGUCA | 1924 |
| 9291 | UUAGCCUUAGUAGAUUAAA | 658 | 9291 | UUAGCCUUAGUAGAUUAAA | 658 | 9309 | UUUAAUCUACUAAGGCUAA | 1925 |
| 9309 | AUGUUUGUUUAAUUACAUG | 659 | 9309 | AUGUUUGUUUAAUUACAUG | 659 | 9327 | CAUGUAAUUAAACAAACAU | 1926 |
| 9345 | ACACAUUAAAUAAAGCUU | 660 | 9345 | ACACAUUAAAUAAAGCUU | 660 | 9363 | AAGCUUUUAUUUAAUGUGU | 1927 |
| 9381 | UCAUUAAUGUUAUCUUGAC | 661 | 9381 | UCAAUAAUGUUAUCUUGAC | 661 | 9399 | GUCAAGAUAACAUUAUUGA | 1928 |
| 9453 | UCUACAUAAUAAAAGAGGU | 662 | 9453 | UCUACAUAAUAAAAGAGGU | 662 | 9471 | ACCUCUUUUAUUAUGUAGA | 1929 |
| 9489 | CUCUAAUUUUAAAUAUAAC | 663 | 9489 | CUCUAAUUUUAAAUAUAAC | 663 | 9507 | GUUAUAUUUAAAAUUAGAG | 1930 |
| 9507 | CAGAAGAAGAUCAAUUCAG | 664 | 9507 | CAGAAGAAGAUCAAUUCAG | 664 | 9525 | CUGAAUUGAUCUUCUUCUG | 1931 |
| 9543 | GUAUGCUCAACAACAUCAC | 665 | 9543 | GUAUGCUCAACAACAUCAC | 665 | 9561 | GUGAUGUUGUUGAGCAUAC | 1932 |
| 9561 | CAGAUGCUGCUAAUAAAGC | 666 | 9561 | CAGAUGCUGCUAAUAAAGC | 666 | 9579 | GCUUUAUUAGCAGCAUCUG | 1933 |
| 9597 | CAAGAGUAUGUCAUACAUU | 667 | 9597 | CAAGAGUAUGUCAUACAUU | 667 | 9615 | AAUGUAUGACAUACUCUUG | 1934 |
| 9633 | CCGAUAAUAUAAUAAAUGG | 668 | 9633 | CCGAUAAUAUAAUAAAUGG | 668 | 9651 | CCAUUUAUUAUAUUAUCGG | 1935 |
| 9651 | GCAGAUGGAUAAUUCUAUU | 669 | 9651 | GCAGAUGGAUAAUUCUAUU | 669 | 9669 | AAUAGAAUUAUCCAUCUGC | 1936 |
| 9669 | UAAGUAAGUUCCUUAAAUU | 670 | 9669 | UAAGUAAGUUCCUUAAAUU | 670 | 9687 | AAUUUAAGGAACUUACUUA | 1937 |
| 9687 | UAAUUAAGCUUGCAGGUGA | 671 | 9687 | UAAUUAAGCUUGCAGGUGA | 671 | 9705 | UCACCUGCAAGCUUAAUUA | 1938 |
| 9705 | ACAAUAACCUUAACAAUCU | 672 | 9705 | ACAAUAACCUUAACAAUCU | 672 | 9723 | AGAUUGUUAAGGUUAUUGU | 1939 |
| 9741 | UGUUCAGAAUAUUUGGACA | 673 | 9741 | UGUUCAGAAUAUUUGGACA | 673 | 9759 | UGUCCAAAUAUUCUGAACA | 1940 |
| 9759 | ACCCAAUGGUAGAUGAAAG | 674 | 9759 | ACCCAAUGGUAGAUGAAAG | 674 | 9777 | CUUUCAUCUACCAUUGGGU | 1941 |
| 9777 | GACAAGCCAUGGAUGCUGU | 675 | 9777 | GACAAGCCAUGGAUGCUGU | 675 | 9795 | ACAGCAUCCAUGGCUUGUC | 1942 |

TABLE II-continued

RSV siNA AND TARGET SEQUENCES

| Pos | Seq | Seq ID | UPos | Upper seq | Seq ID | LPos | Lower seq | Seq ID |
|---|---|---|---|---|---|---|---|---|
| 9813 | AGACCAAAUUUUACUUGUU | 676 | 9813 | AGACCAAAUUUUACUUGUU | 676 | 9831 | AACAAGUAAAAUUUGGUCU | 1943 |
| 9849 | UAAGAGGUGCCUUUAUAUA | 677 | 9849 | UAAGAGGUGCCUUUAUAUA | 677 | 9867 | UAUAUAAAGGCACCUCUUA | 1944 |
| 9885 | UUGUAAAUAAUUACAACAG | 678 | 9885 | UUGUAAAUAAUUACAACAG | 678 | 9903 | CUGUUGUAAUUAUUUACAA | 1945 |
| 9921 | AUGCUAUUGUUUUACCCUU | 679 | 9921 | AUGCUAUUGUUUUACCCUU | 679 | 9939 | AAGGGUAAAACAAUAGCAU | 1946 |
| 9939 | UAAGAUGGUUAACUUACUA | 680 | 9939 | UAAGAUGGUUAACUUACUA | 680 | 9957 | UAGUAAGUUAACCAUCUUA | 1947 |
| 9957 | AUAAACUAAACACUUAUCC | 681 | 9957 | AUAAACUAAACACUUAUCC | 681 | 9975 | GGAUAAGUGUUUAGUUUAU | 1948 |
| 9993 | CAGAAAGAGAUUUGAUUGU | 682 | 9993 | CAGAAAGAGAUUUGAUUGU | 682 | 10011 | ACAAUCAAAUCUCUUUCUG | 1949 |
| 10029 | UCUAUCGUGAGUUUCGGUU | 683 | 10029 | UCUAUCGUGAGUUUCGGUU | 683 | 10047 | AACCGAAACUCACGAUAGA | 1950 |
| 10101 | CUAAAAUUUGAUAUGGAC | 684 | 10101 | CUAAAAUUUGAUAUGGAC | 684 | 10119 | GUCCAUAUCAAAUUUUAG | 1951 |
| 10119 | CUAGUUUCCCUAGAAAUUA | 685 | 10119 | CUAGUUUCCCUAGAAAUUA | 685 | 10137 | UAAUUUCUAGGGAAACUAG | 1952 |
| 10173 | AAAAAUUAAAAUUUUCCGA | 686 | 10173 | AAAAAUUAAAAUUUUCCGA | 686 | 10191 | UCGGAAAAUUUUAAUUUUU | 1953 |
| 10191 | AGAGUGAUAAAUCAAGAAG | 687 | 10191 | AGAGUGAUAAAUCAAGAAG | 687 | 10209 | CUUCUUGAUUUAUCACUCU | 1954 |
| 10227 | UAAGAGAUAACAAAUUCAA | 688 | 10227 | UAAGAGAUAACAAAUUCAA | 688 | 10245 | UUGAAUUUGUUAUCUCUUA | 1955 |
| 10245 | AUGAAUGUGAUUUAUACAA | 689 | 10245 | AUGAAUGUGAUUUAUACAA | 689 | 10263 | UUGUAUAAAUCACAUUCAU | 1956 |
| 10263 | ACUGUGUAGUUAAUCAAAG | 690 | 10263 | ACUGUGUAGUUAAUCAAAG | 690 | 10281 | CUUUGAUUAACUACACAGU | 1957 |
| 10317 | CAGGCAAAGAAAGAGAACU | 691 | 10317 | CAGGCAAAGAAAGAGAACU | 691 | 10335 | AGUUCUCUUUCUUUGCCUG | 1958 |
| 10407 | UAGCUGAAAACAUUUUACA | 692 | 10407 | UAGCUGAAAACAUUUUACA | 692 | 10425 | UGUAAAAUGUUUUCAGCUA | 1959 |
| 10425 | AAUUCUUUCCUGAAAGUCU | 693 | 10425 | AAUUCUUUCCUGAAAGUCU | 693 | 10443 | AGACUUUCAGGAAAGAAUU | 1960 |
| 10443 | UUACAAGAUAUGGUGAUCU | 694 | 10443 | UUACAAGAUAUGGUGAUCU | 694 | 10461 | AGAUCACCAUAUCUUGUAA | 1961 |
| 10497 | UAAGUAACAAAUCAAAUCG | 695 | 10497 | UAAGUAACAAAUCAAAUCG | 695 | 10515 | CGAUUUGAUUUGUUACUUA | 1962 |
| 10533 | ACAAUUACAUUAGUAAGUG | 696 | 10533 | ACAAUUACAUUAGUAAGUG | 696 | 10551 | CACUUACUAAUGUAAUUGU | 1963 |
| 10551 | GCUCUAUCAUCACAGAUCU | 697 | 10551 | GCUCUAUCAUCACAGAUCU | 697 | 10569 | AGAUCUGUGAUGAUAGAGC | 1964 |
| 10569 | UCAGCAAAUUCAAUCAAGC | 698 | 10569 | UCAGCAAAUUCAAUCAAGC | 698 | 10587 | GCUUGAUUGAAUUUGCUGA | 1965 |
| 10605 | CAUGUAUUUGUAGUGAUGU | 699 | 10605 | CAUGUAUUUGUAGUGAUGU | 699 | 10623 | ACAUCACUACAAAUACAUG | 1966 |
| 10677 | UUCCUCAUGUCACAAUAAU | 700 | 10677 | UUCCUCAUGUCACAAUAAU | 700 | 10695 | AUUAUUGUGACAUGAGGAA | 1967 |
| 10695 | UAUGCACAUAUAGGCAUGC | 701 | 10695 | UAUGCACAUAUAGGCAUGC | 701 | 10713 | GCAUGCCUAUAUGUGCAUA | 1968 |
| 10731 | AUCAUAUUGUAGAUCUUAA | 702 | 10731 | AUCAUAUUGUAGAUCUUAA | 702 | 10749 | UUAAGAUCUACAAUAUGAU | 1969 |
| 10749 | ACAAUGUAGAUGAACAAAG | 703 | 10749 | ACAAUGUAGAUGAACAAAG | 703 | 10767 | CUUUGUUCAUCUACAUUGU | 1970 |
| 10767 | GUGGAUUAUAUAGAUAUCA | 704 | 10767 | GUGGAUUAUAUAGAUAUCA | 704 | 10785 | UGAUAUCUAUAUAAUCCAC | 1971 |
| 10803 | GGUGGUGUCAAAAACUAUG | 705 | 10803 | GGUGGUGUCAAAAACUAUG | 705 | 10821 | CAUAGUUUUGACACCACC | 1972 |
| 10821 | GGACCAUAGAAGCUAUAUC | 706 | 10821 | GGACCAUAGAAGCUAUAUC | 706 | 10839 | GAUAUAGCUUCUAUGGUCC | 1973 |
| 10839 | CACUAUUGGAUCUAAUAUC | 707 | 10839 | CACUAUUGGAUCUAAUAUC | 707 | 10857 | GAUAUUAGAUCCAAUAGUG | 1974 |
| 10875 | CAAUUACUGCUUUAAUUAA | 708 | 10875 | CAAUUACUGCUUUAAUUAA | 708 | 10893 | UUAAUUAAAGCAGUAAUUG | 1975 |
| 10893 | AUGGUGACAAUCAAUCAAU | 709 | 10893 | AUGGUGACAAUCAAUCAAU | 709 | 10911 | AUUGAUUGAUUGUCACCAU | 1976 |
| 10929 | UCAGACUCAUGGAAGGUCA | 710 | 10929 | UCAGACUCAUGGAAGGUCA | 710 | 10947 | UGACCUUCCAUGAGUCUGA | 1977 |
| 10965 | AUUAUUUGCUAGCAUUAAA | 711 | 10965 | AUUAUUUGCUAGCAUUAAA | 711 | 10983 | UUUAAUGCUAGCAAAUAAU | 1978 |
| 11037 | GAACUGAGACUUAUAUAUC | 712 | 11037 | GAACUGAGACUUAUAUAUC | 712 | 11055 | GAUAUAUAAGUCUCAGUUC | 1979 |
| 11073 | UGAGUAAAACAAUUCAACA | 713 | 11073 | UGAGUAAAACAAUUCAACA | 713 | 11091 | UGUUGAAUUGUUUUACUCA | 1980 |

TABLE II-continued

RSV siNA AND TARGET SEQUENCES

| Pos | Seq | Seq ID | UPos | Upper seq | Seq ID | LPos | Lower seq | Seq ID |
|---|---|---|---|---|---|---|---|---|
| 11091 | AUAACGGUGUAUAUUACCC | 714 | 11091 | AUAACGGUGUAUAUUACCC | 714 | 11109 | GGGUAAUAUACACCGUUAU | 1981 |
| 11127 | UCCUAAGAGUGGGACCGUG | 715 | 11127 | UCCUAAGAGUGGGACCGUG | 715 | 11145 | CACGGUCCCACUCUUAGGA | 1982 |
| 11145 | GGAUAAACACUAUACUUGA | 716 | 11145 | GGAUAAACACUAUACUUGA | 716 | 11163 | UCAAGUAUAGUGUUUAUCC | 1983 |
| 11163 | AUGAUUUCAAAGUGAGUCU | 717 | 11163 | AUGAUUUCAAAGUGAGUCU | 717 | 11181 | AGACUCACUUUGAAAUCAU | 1984 |
| 11181 | UAGAAUCUAUAGGUAGUUU | 718 | 11181 | UAGAAUCUAUAGGUAGUUU | 718 | 11199 | AAACUACCUAUAGAUUCUA | 1985 |
| 11199 | UGACACAAGAAUUAGAAUA | 719 | 11199 | UGACACAAGAAUUAGAAUA | 719 | 11217 | UAUUCUAAUUCUUGUGUCA | 1986 |
| 11253 | GAAAUGUAUGGUUAUAUAA | 720 | 11253 | GAAAUGUAUGGUUAUAUAA | 720 | 11271 | UUAUAUAACCAUACAUUUC | 1987 |
| 11325 | UGGACAUAUUAAAGGUUCU | 721 | 11325 | UGGACAUAUUAAAGGUUCU | 721 | 11343 | AGAACCUUUAAUAUGUCCA | 1988 |
| 11343 | UGAAACACUUAAAAACCUU | 722 | 11343 | UGAAACACUUAAAAACCUU | 722 | 11361 | AAGGUUUUUAAGUGUUUCA | 1989 |
| 11361 | UUUUUAAUCUUGAUAAUAU | 723 | 11361 | UUUUUAAUCUUGAUAAUAU | 723 | 11379 | AUAUUAUCAAGAUUAAAAA | 1990 |
| 11379 | UUGAUACAGCAUUAACAUU | 724 | 11379 | UUGAUACAGCAUUAACAUU | 724 | 11397 | AAUGUUAAUGCUGUAUCAA | 1991 |
| 11415 | UGUUAUUGGUGGUGGUGA | 725 | 11415 | UGUUAUUGGUGGUGGUGA | 725 | 11433 | UCACCACCACCAAAUAACA | 1992 |
| 11433 | AUCCCAACUUGUUAUAUCG | 726 | 11433 | AUCCCAACUUGUUAUAUCG | 726 | 11451 | CGAUAUAACAAGUUGGGAU | 1993 |
| 11451 | GAAGUUUCUAUAGAAGAAC | 727 | 11451 | GAAGUUUCUAUAGAAGAAC | 727 | 11469 | GUUCUUCUAUAGAAACUUC | 1994 |
| 11487 | AGGCUAUAGUUCACUCUGU | 728 | 11487 | AGGCUAUAGUUCACUCUGU | 728 | 11505 | ACAGAGUGAACUAUAGCCU | 1995 |
| 11505 | UGUUCAUACUUAGUUAUUA | 729 | 11505 | UGUUCAUACUUAGUUAUUA | 729 | 11523 | UAAUAACUAAGUAUGAACA | 1996 |
| 11559 | UGUCAGAUGAUAGAUUGAA | 730 | 11559 | UGUCAGAUGAUAGAUUGAA | 730 | 11577 | UUCAAUCUAUCAUCUGACA | 1997 |
| 11577 | AUAAGUUCUUAACAUGCAU | 731 | 11577 | AUAAGUUCUUAACAUGCAU | 731 | 11595 | AUGCAUGUUAAGAACUUAU | 1998 |
| 11613 | ACCCUAAUGCUGAAUUCGU | 732 | 11613 | ACCCUAAUGCUGAAUUCGU | 732 | 11631 | ACGAAUUCAGCAUUAGGGU | 1999 |
| 11631 | UAACAUUGAUGAGAGAUCC | 733 | 11631 | UAACAUUGAUGAGAGAUCC | 733 | 11649 | GGAUCUCUCAUCAAUGUUA | 2000 |
| 11649 | CUCAAGCUUUAGGGUCUGA | 734 | 11649 | CUCAAGCUUUAGGGUCUGA | 734 | 11667 | UCAGACCCUAAAGCUUGAG | 2001 |
| 11667 | AGAGACAAGCUAAAAUUAC | 735 | 11667 | AGAGACAAGCUAAAAUUAC | 735 | 11685 | GUAAUUUUAGCUUGUCUCU | 2002 |
| 11739 | AAAUAUUCUCCAAAAGUGC | 736 | 11739 | AAAUAUUCUCCAAAAGUGC | 736 | 11757 | GCACUUUUGGAGAAUAUUU | 2003 |
| 11775 | CAGAGAUAGAUCUAAAUGA | 737 | 11775 | CAGAGAUAGAUCUAAAUGA | 737 | 11793 | UCAUUUAGAUCUAUCUCUG | 2004 |
| 11829 | GGCUAAGAGUUGUUUAUGA | 738 | 11829 | GGCUAAGAGUUGUUUAUGA | 738 | 11847 | UCAUAAACAACUCUUAGCC | 2005 |
| 11847 | AAAGUUUACCCUUUUAUAA | 739 | 11847 | AAAGUUUACCCUUUUAUAA | 739 | 11865 | UUAUAAAAGGGUAAACUUU | 2006 |
| 11865 | AAGCAGAGAAAAUAGUAAA | 740 | 11865 | AAGCAGAGAAAAUAGUAAA | 740 | 11883 | UUUACUAUUUUCUCUGCUU | 2007 |
| 11901 | AAUCUAUAACUAACAUACU | 741 | 11901 | AAUCUAUAACUAACAUACU | 741 | 11919 | AGUAUGUUAGUUAUAGAUU | 2008 |
| 11937 | UAGACUUAACAGAUAUUGA | 742 | 11937 | UAGACUUAACAGAUAUUGA | 742 | 11955 | UCAAUAUCUGUUAAGUCUA | 2009 |
| 11955 | AUAGAGCCACUGAGAUGAU | 743 | 11955 | AUAGAGCCACUGAGAUGAU | 743 | 11973 | AUCAUCUCAGUGGCUCUAU | 2010 |
| 11973 | UGAGGAAAACAUAACUUU | 744 | 11973 | UGAGGAAAACAUAACUUU | 744 | 11991 | AAAGUUAUGUUUUCCUCA | 2011 |
| 12045 | GUAUGGAAAACCUAAGUAU | 745 | 12045 | GUAUGGAAAACCUAAGUAU | 745 | 12063 | AUACUUAGGUUUUCCAUAC | 2012 |
| 12063 | UUACUGAAUUAAGCAAAUA | 746 | 12063 | UUACUGAAUUAAGCAAAUA | 746 | 12081 | UAUUUGCUUAAUUCAGUAA | 2013 |
| 12081 | AUGUUAGGGAAAGAUCUUG | 747 | 12081 | AUGUUAGGGAAAGAUCUUG | 747 | 12099 | CAAGAUCUUUCCCUAACAU | 2014 |
| 12099 | GGUCUUUAUCCAAUAUAGU | 748 | 12099 | GGUCUUUAUCCAAUAUAGU | 748 | 12117 | ACUAUAUUGGAUAAAGACC | 2015 |
| 12135 | GUAUCAUGUAUACAAUGGA | 749 | 12135 | GUAUCAUGUAUACAAUGGA | 749 | 12153 | UCCAUUGUAUACAUGAUAC | 2016 |
| 12207 | AUGUUAACAGUUUAACACG | 750 | 12207 | AUGUUAACAGUUUAACACG | 750 | 12225 | CGUGUUAAACUGUUAACAU | 2017 |

TABLE II-continued

RSV siNA AND TARGET SEQUENCES

| Pos | Seq | Seq ID | UPos | Upper seq | Seq ID | LPos | Lower seq | Seq ID |
|---|---|---|---|---|---|---|---|---|
| 12243 | CUAAACCAUGGGUUGGUUC | 751 | 12243 | CUAAACCAUGGGUUGGUUC | 751 | 12261 | GAACCAACCCAUGGUUUAG | 2018 |
| 12261 | CAUCUACACAAGAGAAAAA | 752 | 12261 | CAUCUACACAAGAGAAAAA | 752 | 12279 | UUUUUCUCUUGUGUAGAUG | 2019 |
| 12279 | AAACAAUGCCAGUUUAUAA | 753 | 12279 | AAACAAUGCCAGUUUAUAA | 753 | 12297 | UUAUAAACUGGCAUUGUUU | 2020 |
| 12297 | AUAGACAAGUUUUAACCAA | 754 | 12297 | AUAGACAAGUUUUAACCAA | 754 | 12315 | UUGGUUAAAACUUGUCUAU | 2021 |
| 12333 | UAGAUCUAUUAGCAAAAUU | 755 | 12333 | UAGAUCUAUUAGCAAAAUU | 755 | 12351 | AAUUUUGCUAAUAGAUCUA | 2022 |
| 12351 | UGGAUUGGGUGUAUGCAUC | 756 | 12351 | UGGAUUGGGUGUAUGCAUC | 756 | 12369 | GAUGCAUACACCCAAUCCA | 2023 |
| 12369 | CUAUAGAUAACAAGGAUGA | 757 | 12369 | CUAUAGAUAACAAGGAUGA | 757 | 12387 | UCAUCCUUGUUAUCUAUAG | 2024 |
| 12477 | UGCAUCGCCUUACAGUCAG | 758 | 12477 | UGCAUCGCCUUACAGUCAG | 758 | 12495 | CUGACUGUAAGGCGAUGCA | 2025 |
| 12567 | CUAUUAAUCGCAUAUUAAC | 759 | 12567 | CUAUUAAUCGCAUAUUAAC | 759 | 12585 | GUUAAUAUGCGAUUAAUAG | 2026 |
| 12585 | CAGAAAAGUAUGGUGAUGA | 760 | 12585 | CAGAAAAGUAUGGUGAUGA | 760 | 12603 | UCAUCACCAUACUUUUCUG | 2027 |
| 12621 | UCCAAAACUGUAUAAGCUU | 761 | 12621 | UCCAAAACUGUAUAAGCUU | 761 | 12639 | AAGCUUAUACAGUUUUGGA | 2028 |
| 12657 | CAGUAGUAGAACAAUUUAC | 762 | 12657 | CAGUAGUAGAACAAUUUAC | 762 | 12675 | GUAAAUUGUUCUACUACUG | 2029 |
| 12675 | CUAAUGUAUGUCCUAACAG | 763 | 12675 | CUAAUGUAUGUCCUAACAG | 763 | 12693 | CUGUUAGGACAUACAUUAG | 2030 |
| 12711 | AGCUUAAUGAGAUACAUUU | 764 | 12711 | AGCUUAAUGAGAUACAUUU | 764 | 12729 | AAAUGUAUCUCAUUAAGCU | 2031 |
| 12747 | UCACAGGUGAUGUUGAUAU | 765 | 12747 | UCACAGGUGAUGUUGAUAU | 765 | 12765 | AUAUCAACAUCACCUGUGA | 2032 |
| 12765 | UUCACAAGUUAAAACAAGU | 766 | 12765 | UUCACAAGUUAAAACAAGU | 766 | 12783 | ACUUGUUUUAACUUGUGAA | 2033 |
| 12801 | UGUUUUUACCAGACAAAAU | 767 | 12801 | UGUUUUUACCAGACAAAAU | 767 | 12819 | AUUUUGUCUGGUAAAAACA | 2034 |
| 12819 | UAAGUUUGACUCAAUAUGU | 768 | 12819 | UAAGUUUGACUCAAUAUGU | 768 | 12837 | ACAUAUUGAGUCAAACUUA | 2035 |
| 12837 | UGGAAUUAUUCUUAAGUAA | 769 | 12837 | UGGAAUUAUUCUUAAGUAA | 769 | 12855 | UUACUUAAGAAUAAUUCCA | 2036 |
| 12873 | GAUCUCAUGUUAAUUCUAA | 770 | 12873 | GAUCUCAUGUUAAUUCUAA | 770 | 12891 | UUAGAAUUAACAUGAGAUC | 2037 |
| 12927 | AUAAUACUUACAUUUUAAG | 771 | 12927 | AUAAUACUUACAUUUUAAG | 771 | 12945 | CUUAAAAUGUAAGUAUUAU | 2038 |
| 12981 | AACUUAUGAAAGAUUCUAA | 772 | 12981 | AACUUAUGAAAGAUUCUAA | 772 | 12999 | UUAGAAUCUUUCAUAAGUU | 2039 |
| 13017 | AUUGGGGAGAGGGAUAUAU | 773 | 13017 | AUUGGGGAGAGGGAUAUAU | 773 | 13035 | AUAUAUCCCUCUCCCCAAU | 2040 |
| 13053 | UUAAUUUGAAAGUUUUCUU | 774 | 13053 | UUAAUUUGAAAGUUUUCUU | 774 | 13071 | AAGAAAACUUUCAAAUUAA | 2041 |
| 13071 | UCAAUGCUUAUAAGACCUA | 775 | 13071 | UCAAUGCUUAUAAGACCUA | 775 | 13089 | UAGGUCUUAUAAGCAUUGA | 2042 |
| 13089 | AUCUCUUGUGUUUUCAUAA | 776 | 13089 | AUCUCUUGUGUUUUCAUAA | 776 | 13107 | UUAUGAAAACAAGAGAU | 2043 |
| 13161 | GUGUAUUGGAAUUAAUAGA | 777 | 13161 | GUGUAUUGGAAUUAAUAGA | 777 | 13179 | UCUAUUAAUUCCAAUACAC | 2044 |
| 13179 | ACAGUAGUUAUUGGAAGUC | 778 | 13179 | ACAGUAGUUAUUGGAAGUC | 778 | 13197 | GACUUCCAAUAACUACUGU | 2045 |
| 13197 | CUAUGUCUAAGGUAUUUUU | 779 | 13197 | CUAUGUCUAAGGUAUUUUU | 779 | 13215 | AAAAAUACCUUAGACAUAG | 2046 |
| 13215 | UAGAACAAAAAGUUAUCAA | 780 | 13215 | UAGAACAAAAAGUUAUCAA | 780 | 13233 | UUGAUAACUUUUUGUUCUA | 2047 |
| 13251 | AUGCAAGUUUACAUAGAGU | 781 | 13251 | AUGCAAGUUUACAUAGAGU | 781 | 13269 | ACUCUAUGUAAACUUGCAU | 2048 |
| 13269 | UAAAGGAUGUCAUAGCUU | 782 | 13269 | UAAAGGAUGUCAUAGCUU | 782 | 13287 | AAGCUAUGACAUCCUUUA | 2049 |
| 13359 | AUCAUCCAACACAUAUGAA | 783 | 13359 | AUCAUCCAACACAUAUGAA | 783 | 13377 | UUCAUAUGUGUUGGAUGAU | 2050 |
| 13377 | AAGCAAUAUUAACUUAUAU | 784 | 13377 | AAGCAAUAUUAACUUAUAU | 784 | 13395 | AUAUAAGUUAAUAUUGCUU | 2051 |
| 13395 | UAGAUCUUGUUAGAAUGGG | 785 | 13395 | UAGAUCUUGUUAGAAUGGG | 785 | 13413 | CCCAUUCUAACAAGAUCUA | 2052 |
| 13467 | AAUUUUAUACUUCUAAUCU | 786 | 13467 | AAUUUUAUACUUCUAAUCU | 786 | 13485 | AGAUUAGAAGUAUAAAAUU | 2053 |
| 13503 | ACUUCUCAGAUAAUACUCA | 787 | 13503 | ACUUCUCAGAUAAUACUCA | 787 | 13521 | UGAGUAUUAUCUGAGAAGU | 2054 |
| 13557 | AAUUAGAAAAUAAUUACAA | 788 | 13557 | AAUUAGAAAAUAAUUACAA | 788 | 13575 | UUGUAAUUAUUUUCUAAUU | 2055 |

TABLE II-continued

RSV siNA AND TARGET SEQUENCES

| Pos | Seq | Seq ID | UPos | Upper seq | Seq ID | LPos | Lower seq | Seq ID |
|---|---|---|---|---|---|---|---|---|
| 13575 | ACAAAUUAUAUCAUCCUAC | 789 | 13575 | ACAAAUUAUAUCAUCCUAC | 789 | 13593 | GUAGGAUGAUAUAAUUUGU | 2056 |
| 13665 | GUAUAGGUAAAAAUGUUGA | 790 | 13665 | GUAUAGGUAAAAAUGUUGA | 790 | 13683 | UCAACAUUUUUACCUAUAC | 2057 |
| 13683 | ACUCAAUAAUGUUACCAUU | 791 | 13683 | ACUCAAUAAUGUUACCAUU | 791 | 13701 | AAUGGUAACAUUAUUGAGU | 2058 |
| 13701 | UGUUAUCUAAUAAGAAGCU | 792 | 13701 | UGUUAUCUAAUAAGAAGCU | 792 | 13719 | AGCUUCUUAUUAGAUAACA | 2059 |
| 13737 | UGAUUAGAACCAAUUACAG | 793 | 13737 | UGAUUAGAACCAAUUACAG | 793 | 13755 | CUGUAAUUGGUUCUAAUCA | 2060 |
| 13917 | AUAUUAAUAGAUUCAAUUU | 794 | 13917 | AUAUUAAUAGAUUCAAUUU | 794 | 13935 | AAAUUGAAUCUAUUAAUAU | 2061 |
| 13935 | UUGUAUUUAGUUCUACAGG | 795 | 13935 | UUGUAUUUAGUUCUACAGG | 795 | 13953 | CCUGUAGAACUAAAUACAA | 2062 |
| 13953 | GUUGUAAAAUUAGUAUAGA | 796 | 13953 | GUUGUAAAAUUAGUAUAGA | 796 | 13971 | UCUAUACUAAUUUUACAAC | 2063 |
| 14007 | AUUGUAUAGCAUUCAUAGG | 797 | 14007 | AUUGUAUAGCAUUCAUAGG | 797 | 14025 | CCUAUGAAUGCUAUACAAU | 2064 |
| 14025 | GUGAAGGAGCAGGGAAUUU | 798 | 14025 | GUGAAGGAGCAGGGAAUUU | 798 | 14043 | AAAUUCCCUGCUCCUUCAC | 2065 |
| 14079 | UAAGAUAUAUUUACAGAAG | 799 | 14079 | UAAGAUAUAUUUACAGAAG | 799 | 14097 | CUUCUGUAAAUAUAUCUUA | 2066 |
| 14151 | AUGGACAUAUCAACAUUGA | 800 | 14151 | AUGGACAUAUCAACAUUGA | 800 | 14169 | UCAAUGUUGAUAUGUCCAU | 2067 |
| 14169 | AUUAUGGUGAAAAUUUGAC | 801 | 14169 | AUUAUGGUGAAAAUUUGAC | 801 | 14187 | GUCAAAUUUCACCAUAAU | 2068 |
| 14205 | CAACCAACAACAUUCAUUG | 802 | 14205 | CAACCAACAACAUUCAUUG | 802 | 14223 | CAAUGAAUGUUGUUGGUUG | 2069 |
| 14241 | AGUUUGCUGAACCUAUCAG | 803 | 14241 | AGUUUGCUGAACCUAUCAG | 803 | 14259 | CUGAUAGGUUCAGCAAACU | 2070 |
| 14295 | UCAACUGGAGUAAAAUUAU | 804 | 14295 | UCAACUGGAGUAAAAUUAU | 804 | 14313 | AUAAUUUUACUCCAGUUGA | 2071 |
| 14349 | ACUGUUCCUCAGUUAAUAA | 805 | 14349 | ACUGUUCCUCAGUUAAUAA | 805 | 14367 | UUAUUAACUGAGGAACAGU | 2072 |
| 14421 | ACAAUAUAACUAUAUUAAA | 806 | 14421 | ACAAUAUAACUAUAUUAAA | 806 | 14439 | UUUAAUAUAGUUAUAUUGU | 2073 |
| 14529 | AUGUAGUACAAAAUGCUAA | 807 | 14529 | AUGUAGUACAAAAUGCUAA | 807 | 14547 | UUAGCAUUUUGUACUACAU | 2074 |
| 14547 | AAUUGAUACUAUCAAGAAC | 808 | 14547 | AAUUGAUACUAUCAAGAAC | 808 | 14565 | GUUCUUGAUAGUAUCAAUU | 2075 |
| 14565 | CCAAAAAUUUCAUCAUGCC | 809 | 14565 | CCAAAAAUUUCAUCAUGCC | 809 | 14583 | GGCAUGAUGAAAUUUUUGG | 2076 |
| 14601 | AGUCUAUUGAUGCAAAUAU | 810 | 14601 | AGUCUAUUGAUGCAAAUAU | 810 | 14619 | AUAUUUGCAUCAAUAGACU | 2077 |
| 14619 | UUAAAAGUUUGAUACCCUU | 811 | 14619 | UUAAAAGUUUGAUACCCUU | 811 | 14637 | AAGGGUAUCAAACUUUUAA | 2078 |
| 14637 | UUCUUUGUUACCCUAUAAC | 812 | 14637 | UUCUUUGUUACCCUAUAAC | 812 | 14655 | GUUAUAGGGUAACAAAGAA | 2079 |
| 14655 | CAAAAAAGGAAUUAAUAC | 813 | 14655 | CAAAAAAGGAAUUAAUAC | 813 | 14673 | GUAUUAAUUCCUUUUUUG | 2080 |
| 14673 | CUGCAUUGUCAAAACUAAA | 814 | 14673 | CUGCAUUGUCAAAACUAAA | 814 | 14691 | UUUAGUUUUGACAAUGCAG | 2081 |
| 14691 | AGAGUGUUGUUAGUGGAGA | 815 | 14691 | AGAGUGUUGUUAGUGGAGA | 815 | 14709 | UCUCCACUAACAACACUCU | 2082 |
| 14709 | AUAUACUAUCAUAUUCUAU | 816 | 14709 | AUAUACUAUCAUAUUCUAU | 816 | 14727 | AUAGAAUAUGAUAGUAUAU | 2083 |
| 14745 | UUUUCAGCAAUAAACUUAU | 817 | 14745 | UUUUCAGCAAUAAACUUAU | 817 | 14763 | AUAAGUUUAUUGCUGAAAA | 2084 |
| 14763 | UAAAUCAUAAGCAUAUGAA | 818 | 14763 | UAAAUCAUAAGCAUAUGAA | 818 | 14781 | UUCAUAUGCUUAUGAUUUA | 2085 |
| 14799 | AUCAUGUUUUAAAUUUCAG | 819 | 14799 | AUCAUGUUUUAAAUUUCAG | 819 | 14817 | CUGAAAUUUAAAACAUGAU | 2086 |
| 14817 | GAUCAACAGAACUAAACUA | 820 | 14817 | GAUCAACAGAACUAAACUA | 820 | 14835 | UAGUUUAGUUCUGUUGAUC | 2087 |
| 14853 | UAGAAUCUACAUAUCCUUA | 821 | 14853 | UAGAAUCUACAUAUCCUUA | 821 | 14871 | UAAGGAUAUGUAGAUUCUA | 2088 |
| 14907 | AACUUAAAAACUGAUUAA | 822 | 14907 | AACUUAAAAACUGAUUAA | 822 | 14925 | UUAAUCAGUUUUUAAGUU | 2089 |
| 14943 | UAUACAACUUUCAUAAUGA | 823 | 14943 | UAUACAACUUUCAUAAUGA | 823 | 14961 | UCAUUAUGAAAGUUGUAUA | 2090 |
| 15159 | CGAGAUAUUAGUUUUUGAC | 824 | 15159 | CGAGAUAUUAGUUUUUGAC | 824 | 15177 | GUCAAAAACUAAUAUCUCG | 2091 |
| 3 | GCGAAAAAAUGCGUACAAC | 825 | 3 | GCGAAAAAAUGCGUACAAC | 825 | 21 | GUUGUACGCAUUUUUUCGC | 2092 |

TABLE II-continued

RSV siNA AND TARGET SEQUENCES

| Pos | Seq | Seq ID | UPos | Upper seq | Seq ID | LPos | Lower seq | Seq ID |
|---|---|---|---|---|---|---|---|---|
| 111 | UCAUUGAGUAUGAUAAAG | 826 | 111 | UCAUUGAGUAUGAUAAAG | 826 | 129 | CUUUUAUCAUACUCAAUGA | 2093 |
| 291 | AUUUGCCCUAAUAAUAAUA | 827 | 291 | AUUUGCCCUAAUAAUAAUA | 827 | 309 | UAUUAUUAUUAGGGCAAAU | 2094 |
| 543 | AUCAAUGUCACUAACACCA | 828 | 543 | AUCAAUGUCACUAACACCA | 828 | 561 | UGGUGUUAGUGACAUUGAU | 2095 |
| 597 | GGGCAAAUAAAUCAAUUCA | 829 | 597 | GGGCAAAUAAAUCAAUUCA | 829 | 615 | UGAAUUGAUUUAUUUGCCC | 2096 |
| 741 | AUUUAUAUACUUGAUAAAU | 830 | 741 | AUUUAUAUACUUGAUAAAU | 830 | 759 | AUUUAUCAAGUAUAUAAAU | 2097 |
| 1083 | UUAUAGUAAUUUAAAAUUA | 831 | 1083 | UUAUAGUAAUUUAAAAUUA | 831 | 1101 | UAAUUUUAAAUUACUAUAA | 2098 |
| 1587 | AGGCAUGACUCUCCUGAUU | 832 | 1587 | AGGCAUGACUCUCCUGAUU | 832 | 1605 | AAUCAGGAGAGUCAUGCCU | 2099 |
| 1641 | AUAACCAAAUUAGCAGCAG | 833 | 1641 | AUAACCAAAUUAGCAGCAG | 833 | 1659 | CUGCUGCUAAUUUGGUUAU | 2100 |
| 1821 | AUAGCACAAUCUUCUACCA | 834 | 1821 | AUAGCACAAUCUUCUACCA | 834 | 1839 | UGGUAGAAGAUUGUGCUAU | 2101 |
| 1893 | GGUGCAGGGCAAGUGAUGU | 835 | 1893 | GGUGCAGGGCAAGUGAUGU | 835 | 1911 | ACAUCACUUGCCCUGCACC | 2102 |
| 2091 | CCUCACUUCUCCAGUGUAG | 836 | 2091 | CCUCACUUCUCCAGUGUAG | 836 | 2109 | CUACACUGGAGAAGUGAGG | 2103 |
| 2397 | CUACCAAAUUCCUAGAAUC | 837 | 2397 | CUACCAAAUUCCUAGAAUC | 837 | 2415 | GAUUCUAGGAAUUUGGUAG | 2104 |
| 2721 | AUCAGACAAACGAUAAUAU | 838 | 2721 | AUCAGACAAACGAUAAUAU | 838 | 2739 | AUAUUAUCGUUUGUCUGAU | 2105 |
| 2739 | UAACAGCAAGAUUAGAUAG | 839 | 2739 | UAACAGCAAGAUUAGAUAG | 839 | 2757 | CUAUCUAAUCUUGCUGUUA | 2106 |
| 2829 | CUGCUCGGGAUGGUAUAAG | 840 | 2829 | CUGCUCGGGAUGGUAUAAG | 840 | 2847 | CUUAUACCAUCCCGAGCAG | 2107 |
| 3297 | UCUUAGAAAAGACGAUGA | 841 | 3297 | UCUUAGAAAAAGACGAUGA | 841 | 3315 | UCAUCGUCUUUUUCUAAGA | 2108 |
| 3459 | CAAGAAGUGCAGUGCUAGC | 842 | 3459 | CAAGAAGUGCAGUGCUAGC | 842 | 3477 | GCUAGCACUGCACUUCUUG | 2109 |
| 3873 | AAUACAUAAAGCCACAAAG | 843 | 3873 | AAUACAUAAAGCCACAAAG | 843 | 3891 | CUUUGUGGCUUUAUGUAUU | 2110 |
| 3891 | GUCAAUUUAUAGUAGAUCU | 844 | 3891 | GUCAAUUUAUAGUAGAUCU | 844 | 3909 | AGAUCUACUAUAAAUUGAC | 2111 |
| 4161 | CUCAAAUAAGUUAAUAAAA | 845 | 4161 | CUCAAAUAAGUUAAUAAAA | 845 | 4179 | UUUUAUUAACUUAUUUGAG | 2112 |
| 4197 | AUAAUCAUUGGAGGAAAUC | 846 | 4197 | AUAAUCAUUGGAGGAAAUC | 846 | 4215 | GAUUUCCUCCAAUGAUUAU | 2113 |
| 4377 | CCAUCAUGAUUGCAAUACU | 847 | 4377 | CCAUCAUGAUUGCAAUACU | 847 | 4395 | AGUAUUGCAAUCAUGAUGG | 2114 |
| 4809 | UCAACUUCACUUAUAAUUG | 848 | 4809 | UCAACUUCACUUAUAAUUG | 848 | 4827 | CAAUUAUAAGUGAAGUUGA | 2115 |
| 4827 | GCAGCCAUCAUAUUCAUAG | 849 | 4827 | GCAGCCAUCAUAUUCAUAG | 849 | 4845 | CUAUGAAUAUGAUGGCUGC | 2116 |
| 4917 | ACCCCAACAUACCUCACCC | 850 | 4917 | ACCCCAACAUACCUCACCC | 850 | 4935 | GGGUGAGGUAUGUUGGGGU | 2117 |
| 5025 | AAGUCAACCCUGCAAUCCA | 851 | 5025 | AAGUCAACCCUGCAAUCCA | 851 | 5043 | UGGAUUGCAGGGUUGACUU | 2118 |
| 5043 | ACAACAGUCAAGACCAAAA | 852 | 5043 | ACAACAGUCAAGACCAAAA | 852 | 5061 | UUUUGGUCUUGACUGUUGU | 2119 |
| 5097 | ACCACAAAACAACGCCAAA | 853 | 5097 | ACCACAAAACAACGCCAAA | 853 | 5115 | UUUGGCGUUGUUUUGUGGU | 2120 |
| 5151 | UUUGAAGUGUUCAACUUUG | 854 | 5151 | UUUGAAGUGUUCAACUUUG | 854 | 5169 | CAAAGUUGAACACUUCAAA | 2121 |
| 5259 | AAGCCCACAAAAAAACCAA | 855 | 5259 | AAGCCCACAAAAAAACCAA | 855 | 5277 | UGGGUUUUUUGUGGGCUU | 2122 |
| 5817 | UAAUAUCAAGGAAAAUAAG | 856 | 5817 | UAAUAUCAAGGAAAAUAAG | 856 | 5835 | CUUAUUUUCCUUGAUAUUA | 2123 |
| 5853 | UAAGGUAAAAUUGAUAAAA | 857 | 5853 | UAAGGUAAAAUUGAUAAAA | 857 | 5871 | UUUUAUCAAUUUUACCUUA | 2124 |
| 5871 | ACAAGAAUUAGAUAAAUAU | 858 | 5871 | ACAAGAAUUAGAUAAAUAU | 858 | 5889 | AUAUUUAUCUAAUUCUUGU | 2125 |
| 6105 | GCACCUAGAAGGGGAAGUG | 859 | 6105 | GCACCUAGAAGGGGAAGUG | 859 | 6123 | CACUUCCCCUUCUAGGUGC | 2126 |
| 6159 | GGCUGUAGUCAGCUUAUCA | 860 | 6159 | GGCUGUAGUCAGCUUAUCA | 860 | 6177 | UGAUAAGCUGACUACAGCC | 2127 |
| 6177 | AAAUGGAGUUAGUGUCUUA | 861 | 6177 | AAAUGGAGUUAGUGUCUUA | 861 | 6195 | UAAGACACUAACUCCAUUU | 2128 |
| 6285 | AACUGUGAUAGAGUUCCAA | 862 | 6285 | AACUGUGAUAGAGUUCCAA | 862 | 6303 | UUGGAACUCUAUCACAGUU | 2129 |
| 6339 | AUUUAGUGUUAAUGCAGGU | 863 | 6339 | AUUUAGUGUUAAUGCAGGU | 863 | 6357 | ACCUGCAUUAACACUAAAU | 2130 |

TABLE II-continued

RSV siNA AND TARGET SEQUENCES

| Pos | Seq | Seq ID | UPos | Upper seq | Seq ID | LPos | Lower seq | Seq ID |
|---|---|---|---|---|---|---|---|---|
| 6357 | UGUAACUACACCUGUAAGC | 864 | 6357 | UGUAACUACACCUGUAAGC | 864 | 6375 | GCUUACAGGUGUAGUUACA | 2131 |
| 6789 | AUUCAACCCCAAAUAUGAU | 865 | 6789 | AUUCAACCCCAAAUAUGAU | 865 | 6807 | AUCAUAUUUGGGGUUGAAU | 2132 |
| 6933 | AUUUUCUAACGGGUGCGAU | 866 | 6933 | AUUUUCUAACGGGUGCGAU | 866 | 6951 | AUCGCACCCGUUAGAAAAU | 2133 |
| 7131 | CCAGAGCCUAGCAUUUAUU | 867 | 7131 | CCAGAGCCUAGCAUUUAUU | 867 | 7149 | AAUAAAUGCUAGGCUCUGG | 2134 |
| 7167 | AUUACAUAAUGUAAAUGCU | 868 | 7167 | AUUACAUAAUGUAAAUGCU | 868 | 7185 | AGCAUUUACAUUAUGUAAU | 2135 |
| 7347 | UAGUAACUAAAUAAAAAUA | 869 | 7347 | UAGUAACUAAAUAAAAAUA | 869 | 7365 | UAUUUUAUUUAGUUACUA | 2136 |
| 7455 | AACUCUCAUCUAUAAACCA | 870 | 7455 | AACUCUCAUCUAUAAACCA | 870 | 7473 | UGGUUUAUAGAUGAGAGUU | 2137 |
| 7563 | AACUGGGGCAAAUAUGUCA | 871 | 7563 | AACUGGGGCAAAUAUGUCA | 871 | 7581 | UGACAUAUUUGCCCCAGUU | 2138 |
| 7635 | GUGUCAUUUUAGUCAUAAU | 872 | 7635 | GUGUCAUUUUAGUCAUAAU | 872 | 7653 | AUUAUGACUAAAAUGACAC | 2139 |
| 7671 | CCAUGCACUGCUUGUAAGA | 873 | 7671 | CCAUGCACUGCUUGUAAGA | 873 | 7689 | UCUUACAAGCAGUGCAUGG | 2140 |
| 8103 | AAAAGAAUCAACUGUUAGU | 874 | 8103 | AAAAGAAUCAACUGUUAGU | 874 | 8121 | ACUAACAGUUGAUUCUUUU | 2141 |
| 8211 | UUACUAUGUAUAAUCAAAA | 875 | 8211 | UUACUAUGUAUAAUCAAAA | 875 | 8229 | UUUUGAUUAUACAUAGUAA | 2142 |
| 8301 | UCCAUUGGACCUCUCAAGA | 876 | 8301 | UCCAUUGGACCUCUCAAGA | 876 | 8319 | UCUUGAGAGGUCCAAUGGA | 2143 |
| 8337 | AAAAUUUUCUACAACAUCU | 877 | 8337 | AAAAUUUUCUACAACAUCU | 877 | 8355 | AGAUGUUGUAGAAAAUUUU | 2144 |
| 8715 | AACCUACUUAUUUUCAGUC | 878 | 8715 | AACCUACUUAUUUUCAGUC | 878 | 8733 | GACUGAAAAUAAGUAGGUU | 2145 |
| 8895 | AUGGACAAGAUGAAGACAA | 879 | 8895 | AUGGACAAGAUGAAGACAA | 879 | 8913 | UUGUCUUCAUCUUGUCCAU | 2146 |
| 9363 | UAGGCUUAAGAUGCGGAUU | 880 | 9363 | UAGGCUUAAGAUGCGGAUU | 880 | 9381 | AAUCCGCAUCUUAAGCCUA | 2147 |
| 9579 | CUCAGAAAAAUCUGCUAUC | 881 | 9579 | CUCAGAAAAAUCUGCUAUC | 881 | 9597 | GAUAGCAGAUUUUCUGAG | 2148 |
| 10155 | AAAAUUAUAUAGAACAUGA | 882 | 10155 | AAAAUUAUAUAGAACAUGA | 882 | 10173 | UCAUGUUCUAUAUAAUUUU | 2149 |
| 10479 | UAGAAUUGAAAGCAGGAAU | 883 | 10479 | UAGAAUUGAAAGCAGGAAU | 883 | 10497 | AUUCCUGCUUUCAAUUCUA | 2150 |
| 11019 | UAGGCCACAAAUUAAAAGG | 884 | 11019 | UAGGCCACAAAUUAAAAGG | 884 | 11037 | CCUUUUAAUUUGUGGCCUA | 2151 |
| 11109 | CAGCUAGUAUAAAGAAAGU | 885 | 11109 | CAGCUAGUAUAAAGAAAGU | 885 | 11127 | ACUUUCUUUAUACUAGCUG | 2152 |
| 11289 | UAAAAAUCAUGCAUUAUG | 886 | 11289 | UAAAAAUCAUGCAUUAUG | 886 | 11307 | CAUAAUGCAUGAUUUUUA | 2153 |
| 11541 | AAGAUAAACUUCAAGAUCU | 887 | 11541 | AAGAUAAACUUCAAGAUCU | 887 | 11559 | AGAUCUUGAAGUUUAUCUU | 2154 |
| 11685 | CUAGCGAAAUCAAUAGACU | 888 | 11685 | CUAGCGAAAUCAAUAGACU | 888 | 11703 | AGUCUAUUGAUUUCGCUAG | 2155 |
| 12225 | GUGGUGAGAGAGGACCCAC | 889 | 12225 | GUGGUGAGAGAGGACCCAC | 889 | 12243 | GUGGGUCCUCUCUCACCAC | 2156 |
| 12315 | AAAAACAGAGAGAUCAAAU | 890 | 12315 | AAAAACAGAGAGAUCAAAU | 890 | 12333 | AUUUGAUCUCUCUGUUUUU | 2157 |
| 12855 | AUAAAACACUCAAAUCUGG | 891 | 12855 | AUAAAACACUCAAAUCUGG | 891 | 12873 | CCAGAUUUGAGUGUUUUAU | 2158 |
| 12963 | AUUGGAUUCUGAUUAUACA | 892 | 12963 | AUUGGAUUCUGAUUAUACA | 892 | 12981 | UGUAUAAUCAGAAUCCAAU | 2159 |
| 13035 | UAACUGAUCAUAUGUUCAU | 893 | 13035 | UAACUGAUCAUAUGUUCAU | 893 | 13053 | AUGAACAUAUGAUCAGUUA | 2160 |
| 13125 | AGCUGGAGUGUGAUAUGAA | 894 | 13125 | AGCUGGAGUGUGAUAUGAA | 894 | 13143 | UUCAUAUCACACUCCAGCU | 2161 |
| 13305 | AACGUCUUAAUGUAGCAGA | 895 | 13305 | AACGUCUUAAUGUAGCAGA | 895 | 13323 | UCUGCUACAUUAAGACGUU | 2162 |
| 13323 | AAUUCACAGUUUGCCCUUG | 896 | 13323 | AAUUCACAGUUUGCCCUUG | 896 | 13341 | CAAGGGCAAACUGUGAAUU | 2163 |
| 13539 | UAAGGAUUGCUAAUUCUGA | 897 | 13539 | UAAGGAUUGCUAAUUCUGA | 897 | 13557 | UCAGAAUUAGCAAUCCUUA | 2164 |
| 13647 | AGACACUGAAUGACUAUUG | 898 | 13647 | AGACACUGAAUGACUAUUG | 898 | 13665 | CAAUAGUCAUUCAGUGUCU | 2165 |
| 13755 | GCAAACAAGAUUUGUAUAA | 899 | 13755 | GCAAACAAGAUUUGUAUAA | 899 | 13773 | UUAUACAAAUCUUGUUUGC | 2166 |
| 13809 | AUCAUUCAGGUAAUACAGC | 900 | 13809 | AUCAUUCAGGUAAUACAGC | 900 | 13827 | GCUGUAUUACCUGAAUGAU | 2167 |

TABLE II-continued

RSV siNA AND TARGET SEQUENCES

| Pos | Seq | Seq ID | UPos | Upper seq | Seq ID | LPos | Lower seq | Seq ID |
|---|---|---|---|---|---|---|---|---|
| 14133 | AGUUUUUAAGGCUGUACAA | 901 | 14133 | AGUUUUUAAGGCUGUACAA | 901 | 14151 | UUGUACAGCCUUAAAAACU | 2168 |
| 14259 | GUCUUUUUGUCUGUGAUGC | 902 | 14259 | GUCUUUUUGUCUGUGAUGC | 902 | 14277 | GCAUCACAGACAAAAAGAC | 2169 |
| 14439 | AAACUUAUGUAUGCUUAGG | 903 | 14439 | AAACUUAUGUAUGCUUAGG | 903 | 14457 | CCUAAGCAUACAUAAGUUU | 2170 |
| 14475 | CUGAAGUUUACUUAGUCCU | 904 | 14475 | CUGAAGUUUACUUAGUCCU | 904 | 14493 | AGGACUAAGUAAACUUCAG | 2171 |
| 14781 | ACAUCUUAAAAUGGUUCAA | 905 | 14781 | ACAUCUUAAAAUGGUUCAA | 905 | 14799 | UUGAACCAUUUUAAGAUGU | 2172 |
| 4053 | AUUCUUCACUUCACCAUCA | 906 | 4053 | AUUCUUCACUUCACCAUCA | 906 | 4071 | UGAUGGUGAAGUGAAGAAU | 2173 |
| 10947 | AAACUCAUGCUCAAGCAGA | 907 | 10947 | AAACUCAUGCUCAAGCAGA | 907 | 10965 | UCUGCUUGAGCAUGAGUUU | 2174 |
| 14043 | UAUUAUUGCGUACAGUAGU | 908 | 14043 | UAUUAUUGCGUACAGUAGU | 908 | 14061 | ACUACUGUACGCAAUAAUA | 2175 |
| 2703 | CAUAUGAAGAAAUAAAUGA | 909 | 2703 | CAUAUGAAGAAAUAAAUGA | 909 | 2721 | UCAUUUAUUUCUUCAUAUG | 2176 |
| 7185 | UGGUAAAUCCACCAUAAAU | 910 | 7185 | UGGUAAAUCCACCAUAAAU | 910 | 7203 | AUUUAUGGUGGAUUUACCA | 2177 |
| 21 | CAAACUUGCGUAAACCAAA | 911 | 21 | CAAACUUGCGUAAACCAAA | 911 | 39 | UUUGGUUUACGCAAGUUUG | 2178 |
| 183 | UGCUAUACUGACAAAUUAA | 912 | 183 | UGCUAUACUGACAAAUUAA | 912 | 201 | UUAAUUUGUCAGUAUAGCA | 2179 |
| 651 | CACACCACAAAGACUGAUG | 913 | 651 | CACACCACAAAGACUGAUG | 913 | 669 | CAUCAGUCUUUGUGGUGUG | 2180 |
| 723 | AGACAUCAUAACACACAGA | 914 | 723 | AGACAUCAUAACACACAGA | 914 | 741 | UCUGUGUGUUAUGAUGUCU | 2181 |
| 993 | CAAUCCAUGAAUUUCAACA | 915 | 993 | CAAUCCAUGAAUUUCAACA | 915 | 1011 | UGUUGAAAUUCAUGGAUUG | 2182 |
| 1659 | GGGGAUAGAUCUGGUCUUA | 916 | 1659 | GGGGAUAGAUCUGGUCUUA | 916 | 1677 | UAAGACCAGAUCUAUCCCC | 2183 |
| 1749 | GAUAUAGCCAACAGCUUCU | 917 | 1749 | GAUAUAGCCAACAGCUUCU | 917 | 1767 | AGAAGCUGUUGGCUAUAUC | 2184 |
| 1929 | GCAAAUCAGUUAAAAAUA | 918 | 1929 | GCAAAUCAGUUAAAAAUA | 918 | 1947 | UAUUUUUAACUGAUUUGC | 2185 |
| 2235 | AGUGUAUUAGACUUGACAG | 919 | 2235 | AGUGUAUUAGACUUGACAG | 919 | 2253 | CUGUCAAGUCUAAUACACU | 2186 |
| 2433 | CAUCACCUAAAGAUCCCAA | 920 | 2433 | CAUCACCUAAAGAUCCCAA | 920 | 2451 | UUGGGAUCUUUAGGUGAUG | 2187 |
| 2631 | AUAAUCCCUUUUCAAAACU | 921 | 2631 | AUAAUCCCUUUUCAAAACU | 921 | 2649 | AGUUUUGAAAAGGGAUUAU | 2188 |
| 2685 | AAGAAGAAUCUAGCUAUUC | 922 | 2685 | AAGAAGAAUCUAGCUAUUC | 922 | 2703 | GAAUAGCUAGAUUCUUCUU | 2189 |
| 2793 | UUCACACAUUAGUAGUAGC | 923 | 2793 | UUCACACAUUAGUAGUAGC | 923 | 2811 | GCUACUACUAAUGUGUGAA | 2190 |
| 3009 | AGAAAUUGAACAACCUGUU | 924 | 3009 | AGAAAUUGAACAACCUGUU | 924 | 3027 | AACAGGUUGUUCAAUUUCU | 2191 |
| 3099 | CACAACACCAACAGAAGAC | 925 | 3099 | CACAACACCAACAGAAGAC | 925 | 3117 | GUCUUCUGUUGGUGUUGUG | 2192 |
| 3603 | AUAUGUUAACUACAGUUAA | 926 | 3603 | AUAUGUUAACUACAGUUAA | 926 | 3621 | UUAACUGUAGUUAACAUAU | 2193 |
| 4629 | ACUAACAAUAACGUUGGGG | 927 | 4629 | ACUAACAAUAACGUUGGGG | 927 | 4647 | CCCCAACGUUAUUGUUAGU | 2194 |
| 4701 | AAGACCUGGGACACUCUCA | 928 | 4701 | AAGACCUGGGACACUCUCA | 928 | 4719 | UGAGAGUGUCCCAGGUCUU | 2195 |
| 4755 | UUAAAUCUUAAAUCUAUAG | 929 | 4755 | UUAAAUCUUAAAUCUAUAG | 929 | 4773 | CUAUAGAUUUAAGAUUUAA | 2196 |
| 4863 | GUCACACUAACAACUGCAA | 930 | 4863 | GUCACACUAACAACUGCAA | 930 | 4881 | UUGCAGUUGUUAGUGUGAC | 2197 |
| 4953 | AUCAGCUUCUCCAAUCUGU | 931 | 4953 | AUCAGCUUCUCCAAUCUGU | 931 | 4971 | ACAGAUUGGAGAAGCUGAU | 2198 |
| 4989 | ACCACCACCAUACUAGCUU | 932 | 4989 | ACCACCACCAUACUAGCUU | 932 | 5007 | AAGCUAGUAUGGUGGUGGU | 2199 |
| 5115 | AACAAACCACCAAACAAAC | 933 | 5115 | AACAAACCACCAAACAAAC | 933 | 5133 | GUUUGUUUGGUGGUUUGUU | 2200 |
| 5241 | GGAAAGAAAACCACCACCA | 934 | 5241 | GGAAAGAAAACCACCACCA | 934 | 5259 | UGGUGGUGGUUUUCUUUCC | 2201 |
| 5295 | AAAGAUCUCAAACCUCAAA | 935 | 5295 | AAAGAUCUCAAACCUCAAA | 935 | 5313 | UUUGAGGUUUGAGAUCUUU | 2202 |
| 5763 | UCUUAGUGCUCUAAGAACU | 936 | 5763 | UCUUAGUGCUCUAAGAACU | 936 | 5781 | AGUUCUAGAGCACUAAGA | 2203 |
| 5781 | UGGUUGGUAUACUAGUGUU | 937 | 5781 | UGGUUGGUAUACUAGUGUU | 937 | 5799 | AACACUAGUAUACCAACCA | 2204 |
| 5979 | UUAUACACUCAACAAUACC | 938 | 5979 | UUAUACACUCAACAAUACC | 938 | 5997 | GGUAUUGUUGAGUGUAUAA | 2205 |

TABLE II-continued

RSV siNA AND TARGET SEQUENCES

| Pos | Seq | Seq ID | UPos | Upper seq | Seq ID | LPos | Lower seq | Seq ID |
|---|---|---|---|---|---|---|---|---|
| 6069 | UGCAAUCGCCAGUGGCAUU | 939 | 6069 | UGCAAUCGCCAGUGGCAUU | 939 | 6087 | AAUGCCACUGGCGAUUGCA | 2206 |
| 6699 | AACAUGUAAAGUUCAAUCG | 940 | 6699 | AACAUGUAAAGUUCAAUCG | 940 | 6717 | CGAUUGAACUUUACAUGUU | 2207 |
| 6717 | GAAUCGAGUAUUUUGUGAC | 941 | 6717 | GAAUCGAGUAUUUUGUGAC | 941 | 6735 | GUCACAAAAUACUCGAUUC | 2208 |
| 7005 | UGUAAAUAAGCAAGAAGGC | 942 | 7005 | UGUAAAUAAGCAAGAAGGC | 942 | 7023 | GCCUUCUUGCUUAUUUACA | 2209 |
| 7023 | CAAAAGUCUCUAUGUAAAA | 943 | 7023 | CAAAAGUCUCUAUGUAAAA | 943 | 7041 | UUUUACAUAGAGACUUUUG | 2210 |
| 7113 | AGUCAAUGAGAAGAUUAAC | 944 | 7113 | AGUCAAUGAGAAGAUUAAC | 944 | 7131 | GUUAAUCUUCUCAUUGACU | 2211 |
| 7311 | CAAGGAUCAACUGAGUGGU | 945 | 7311 | CAAGGAUCAACUGAGUGGU | 945 | 7329 | ACCACUCAGUUGAUCCUUG | 2212 |
| 7419 | UAUCAUUGGAUUUUCUUAA | 946 | 7419 | UAUCAUUGGAUUUUCUUAA | 946 | 7437 | UUAAGAAAAUCCAAUGAUA | 2213 |
| 7527 | GAAUACCAGAUUAACUUAC | 947 | 7527 | GAAUACCAGAUUAACUUAC | 947 | 7545 | GUAAGUUAAUCUGGUAUUC | 2214 |
| 9039 | AGAAAUUAAUGUGUUCAAU | 948 | 9039 | AGAAAUUAAUGUGUUCAAU | 948 | 9057 | AUUGAACACAUUAAUUUCU | 2215 |
| 9093 | AUUUAUACACAAAAUUAAA | 949 | 9093 | AUUUAUACACAAAAUUAAA | 949 | 9111 | UUUAAUUUUGUGUAUAAAU | 2216 |
| 9201 | UUUUGAAUCAAUAUGGUUG | 950 | 9201 | UUUUGAAUCAAUAUGGUUG | 950 | 9219 | CAACCAUAUUGAUUCAAAA | 2217 |
| 9615 | UAUUAGAUAAGACAGUAUC | 951 | 9615 | UAUUAGAUAAGACAGUAUC | 951 | 9633 | GAUACUGUCUUAUCUAAUA | 2218 |
| 9831 | UAAGCAGUUUGAGUAUGUU | 952 | 9831 | UAAGCAGUUUGAGUAUGUU | 952 | 9849 | AACAUACUCAAACUGCUUA | 2219 |
| 10137 | AUAUGCCGUCACACAUACA | 953 | 10137 | AUAUGCCGUCACACAUACA | 953 | 10155 | UGUAUGUGUGACGGCAUAU | 2220 |
| 10713 | CACCCCCUAUAUAAGAGA | 954 | 10713 | CACCCCCUAUAUAAGAGA | 954 | 10731 | UCUCUUAUAUAGGGGGUG | 2221 |
| 11307 | GUAACAAUAAAUUAUAUUU | 955 | 11307 | GUAACAAUAAAUUAUAUUU | 955 | 11325 | AAAUAUAAUUUAUUGUUAC | 2222 |
| 11469 | CUCCUGAUUUCCUCACAGA | 956 | 11469 | CUCCUGAUUUCCUCACAGA | 956 | 11487 | UCUGUGAGGAAAUCAGGAG | 2223 |
| 11811 | AACCUACAUAUCCUCACGG | 957 | 11811 | AACCUACAUAUCCUCACGG | 957 | 11829 | CCGUGAGGAUAUGUAGGUU | 2224 |
| 11919 | UGGAAAAGACUUCUGCCAU | 958 | 11919 | UGGAAAAGACUUCUGCCAU | 958 | 11937 | AUGGCAGAAGUCUUUUCCA | 2225 |
| 12153 | ACAUCAAAUAUACAACAAG | 959 | 12153 | ACAUCAAAUAUACAACAAG | 959 | 12171 | CUUGUUGUAUAUUUGAUGU | 2226 |
| 12171 | GCACUAUAGCUAGUGGCAU | 960 | 12171 | GCACUAUAGCUAGUGGCAU | 960 | 12189 | AUGCCACUAGCUAUAGUGC | 2227 |
| 12441 | AAAAAUUAUUCCACAAUA | 961 | 12441 | AAAAAUUAUUCCACAAUA | 961 | 12459 | UAUUGUGGAAUAAUUUUU | 2228 |
| 12639 | UUGGCCUUAGCUUAAUGUC | 962 | 12639 | UUGGCCUUAGCUUAAUGUC | 962 | 12657 | GACAUUAAGCUAAGGCCAA | 2229 |
| 13485 | UCUUUUACAUUAAUUAUAA | 963 | 13485 | UCUUUUACAUUAAUUAUAA | 963 | 13503 | UUAUAAUUAAUGUAAAAGA | 2230 |
| 13521 | AUCUAUUAACUAAACAUAU | 964 | 13521 | AUCUAUUAACUAAACAUAU | 964 | 13539 | AUAUGUUUAGUUAAUAGAU | 2231 |
| 13881 | AUAGCACAUCACUUUAUUG | 965 | 13881 | AUAGCACAUCACUUUAUUG | 965 | 13899 | CAAUAAAGUGAUGUGCUAU | 2232 |
| 13971 | AGUAUAUUUUAAAAGACCU | 966 | 13971 | AGUAUAUUUUAAAAGACCU | 966 | 13989 | AGGUCUUUUAAAAUAUACU | 2233 |
| 14331 | AUGUAAGAAAAUGCAAGUA | 967 | 14331 | AUGUAAGAAAAUGCAAGUA | 967 | 14349 | UACUUGCAUUUUCUUACAU | 2234 |
| 14367 | AAUGUACGUUAAUAGUAAA | 968 | 14367 | AAUGUACGUUAAUAGUAAA | 968 | 14385 | UUUACUAUUAACGUACAUU | 2235 |
| 14493 | UUACAAUAGGUCCUGCAAA | 969 | 14493 | UUACAAUAGGUCCUGCAAA | 969 | 14511 | UUUGCAGGACCUAUUGUAA | 2236 |
| 14889 | ACAGCUUGACAACUAAUGA | 970 | 14889 | ACAGCUUGACAACUAAUGA | 970 | 14907 | UCAUUAGUUGUCAAGCUGU | 2237 |
| 15087 | UUAUCAUUUGAUCUAGGA | 971 | 15087 | UUAUCAUUUUGAUCUAGGA | 971 | 15105 | UCCUAGAUCAAAAUGAUAA | 2238 |
| 525 | AUAAAUAUCAACUAGCAAA | 972 | 525 | AUAAAUAUCAACUAGCAAA | 972 | 543 | UUUGCUAGUUGAUAUUUAU | 2239 |
| 579 | UGACAGAAGAUAAAAAUGG | 973 | 579 | UGACAGAAGAUAAAAAUGG | 973 | 597 | CCAUUUUUAUCUUCUGUCA | 2240 |
| 615 | AGCCGACCCAACCAUGGAC | 974 | 615 | AGCCGACCCAACCAUGGAC | 974 | 633 | GUCCAUGGUUGGGUCGGCU | 2241 |
| 633 | CACAACACACAAUGACACC | 975 | 633 | CACAACACACAAUGACACC | 975 | 651 | GGUGUCAUUGUGUGUUGUG | 2242 |

TABLE II-continued

RSV siNA AND TARGET SEQUENCES

| Pos | Seq | Seq ID | UPos | Upper seq | Seq ID | LPos | Lower seq | Seq ID |
|---|---|---|---|---|---|---|---|---|
| 669 | GAUCACAGACAUGAGACCA | 976 | 669 | GAUCACAGACAUGAGACCA | 976 | 687 | UGGUCUCAUGUCUGUGAUC | 2243 |
| 687 | AUUGUCACUUGAGACUAUA | 977 | 687 | AUUGUCACUUGAGACUAUA | 977 | 705 | UAUAGUCUCAAGUGACAAU | 2244 |
| 705 | AAUAAUAUCACUAACCAGA | 978 | 705 | AAUAAUAUCACUAACCAGA | 978 | 723 | UCUGGUUAGUGAUAUUAUU | 2245 |
| 759 | UCAUGAAUGUAUAGUGAGA | 979 | 759 | UCAUGAAUGUAUAGUGAGA | 979 | 777 | UCUCACUAUACAUUCAUGA | 2246 |
| 831 | ACUAUUGCACAAAGUGGGA | 980 | 831 | ACUAUUGCACAAAGUGGGA | 980 | 849 | UCCCACUUUGUGCAAUAGU | 2247 |
| 849 | AAGCACUAAAUACAAAAAA | 981 | 849 | AAGCACUAAAUACAAAAAA | 981 | 867 | UUUUUUGUAUUUAGUGCUU | 2248 |
| 885 | AAAAUAUGGCACUUUUCCU | 982 | 885 | AAAAUAUGGCACUUUUCCU | 982 | 903 | AGGAAAAGUGCCAUAUUUU | 2249 |
| 903 | UAUGCCAAUAUUUAUCAAU | 983 | 903 | UAUGCCAAUAUUUAUCAAU | 983 | 921 | AUUGAUAAAUAUUGGCAUA | 2250 |
| 957 | UACAAAGCACACUCCCAUA | 984 | 957 | UACAAAGCACACUCCCAUA | 984 | 975 | UAUGGGAGUGUGCUUUGUA | 2251 |
| 1011 | ACAAGAGUCACACAAUCUG | 985 | 1011 | ACAAGAGUCACACAAUCUG | 985 | 1029 | CAGAUUGUGUGACUCUUGU | 2252 |
| 1029 | GAAAUAACAACUUCAUGCA | 986 | 1029 | GAAAUAACAACUUCAUGCA | 986 | 1047 | UGCAUGAAGUUGUUAUUUC | 2253 |
| 1047 | AUAACCACACUCCAUAGUU | 987 | 1047 | AUAACCACACUCCAUAGUU | 987 | 1065 | AACUAUGGAGUGUGGUUAU | 2254 |
| 1065 | UCAAAUGGAGCCUGAAAAU | 988 | 1065 | UCAAAUGGAGCCUGAAAAU | 988 | 1083 | AUUUUCAGGCUCCAUUUGA | 2255 |
| 1101 | AAGGAGAGACAUAAGAUGA | 989 | 1101 | AAGGAGAGACAUAAGAUGA | 989 | 1119 | UCAUCUUAUGUCUCUCCUU | 2256 |
| 1119 | AAAGAUGGGCAAAUACAA | 990 | 1119 | AAAGAUGGGCAAAUACAA | 990 | 1137 | UUGUAUUUGCCCAUCUUU | 2257 |
| 1137 | AAAAUGGCUCUUAGCAAAG | 991 | 1137 | AAAAUGGCUCUUAGCAAAG | 991 | 1155 | CUUUGCUAAGAGCCAUUUU | 2258 |
| 1353 | UCUAGAUUAGGAAGAGAAG | 992 | 1353 | UCUAGAUUAGGAAGAGAAG | 992 | 1371 | CUUCUCUUCCUAAUCUAGA | 2259 |
| 1407 | GUAAAAGCAAAUGGAGUGG | 993 | 1407 | GUAAAAGCAAAUGGAGUGG | 993 | 1425 | CCACUCCAUUUGCUUUUAC | 2260 |
| 1479 | UUAACAUUGUCAAGCUUAA | 994 | 1479 | UUAACAUUGUCAAGCUUAA | 994 | 1497 | UUAAGCUUGACAAUGUUAA | 2261 |
| 1623 | UGUAUAGCGGCAUUAGUAA | 995 | 1623 | UGUAUAGCGGCAUUAGUAA | 995 | 1641 | UUACUAAUGCCGCUAUACA | 2262 |
| 1677 | ACAGCUGUGAUUAGGAGGG | 996 | 1677 | ACAGCUGUGAUUAGGAGGG | 996 | 1695 | CCCUCCUAAUCACAGCUGU | 2263 |
| 1713 | AAUGAAAUGAAACGUUAUA | 997 | 1713 | AAUGAAAUGAAACGUUAUA | 997 | 1731 | UAUAACGUUUCAUUUCAUU | 2264 |
| 1767 | UAUGAAGUGUUUGAAAAAU | 998 | 1767 | UAUGAAGUGUUUGAAAAAU | 998 | 1785 | AUUUUUCAAACACUUCAUA | 2265 |
| 1785 | UAUCCUCACUUUAUAGAUG | 999 | 1785 | UAUCCUCACUUUAUAGAUG | 999 | 1803 | CAUCUAUAAAGUGAGGAUA | 2266 |
| 1857 | GAAGGGAUUUUUGCUGGAU | 1000 | 1857 | GAAGGGAUUUUUGCUGGAU | 1000 | 1875 | AUCCAGCAAAAAUCCCUUC | 2267 |
| 1911 | UUACGGUGGGGGUCUUAG | 1001 | 1911 | UUACGGUGGGGGUCUUAG | 1001 | 1929 | CUAAGACCCCCCACCGUAA | 2268 |
| 1947 | AUUAUGCUAGGACACGCUA | 1002 | 1947 | AUUAUGCUAGGACACGCUA | 1002 | 1965 | UAGCGUGUCCUAGCAUAAU | 2269 |
| 1983 | GAACAAGUUGUGGAGGUUU | 1003 | 1983 | GAACAAGUUGUGGAGGUUU | 1003 | 2001 | AAACCUCCACAACUUGUUC | 2270 |
| 2019 | UUGGGUGGAGAAGCAGGGU | 1004 | 2019 | UUGGGUGGAGAAGCAGGGU | 1004 | 2037 | ACCCUGCUUCUCCACCCAA | 2271 |
| 2073 | UUGUCUUUGACUCAAUUUC | 1005 | 2073 | UUGUCUUUGACUCAAUUUC | 1005 | 2091 | GAAAUUGAGUCAAAGACAA | 2272 |
| 2145 | GAAUACAGAGGUACACCAA | 1006 | 2145 | GAAUACAGAGGUACACCAA | 1006 | 2163 | UUGGUGUACCUCUGUAUUC | 2273 |
| 2181 | GAUGCUGCAAAAGCAUAUG | 1007 | 2181 | GAUGCUGCAAAAGCAUAUG | 1007 | 2199 | CAUAUGCUUUUGCAGCAUC | 2274 |
| 2379 | AAGAUGCAAACAACAGAGC | 1008 | 2379 | AAGAUGCAAACAACAGAGC | 1008 | 2397 | GCUCUGUUGUUUGCAUCUU | 2275 |
| 2523 | AUUCAACCAUUAUAAACCC | 1009 | 2523 | AUUCAACCAUUAUAAACCC | 1009 | 2541 | GGGUUUAUAAUGGUUGAAU | 2276 |
| 2559 | AUACUGUAGGGAACAAGCC | 1010 | 2559 | AUACUGUAGGGAACAAGCC | 1010 | 2577 | GGCUUGUUCCCUACAGUAU | 2277 |
| 2613 | AAGACCCUACGCCAAGUGA | 1011 | 2613 | AAGACCCUACGCCAAGUGA | 1011 | 2631 | UCACUUGGCGUAGGGUCUU | 2278 |
| 2811 | CGAGUGCAGGACCUACAUC | 1012 | 2811 | CGAGUGCAGGACCUACAUC | 1012 | 2829 | GAUGUAGGUCCUGCACUCG | 2279 |
| 2919 | GACUAGAAGCUAUGGCAAG | 1013 | 2919 | GACUAGAAGCUAUGGCAAG | 1013 | 2937 | CUUGCCAUAGCUUCUAGUC | 2280 |

TABLE II-continued

RSV siNA AND TARGET SEQUENCES

| Pos | Seq | Seq ID | UPos | Upper seq | Seq ID | LPos | Lower seq | Seq ID |
|---|---|---|---|---|---|---|---|---|
| 3063 | AUGAUUUCUGAUCAGUUAC | 1014 | 3063 | AUGAUUUCUGAUCAGUUAC | 1014 | 3081 | GUAACUGAUCAGAAAUCAU | 2281 |
| 3081 | CCAAUCUGUACAUCAACAC | 1015 | 3081 | CCAAUCUGUACAUCAACAC | 1015 | 3099 | GUGUUGAUGUACAGAUUGG | 2282 |
| 3117 | CCAACAAACAAACCAACUC | 1016 | 3117 | CCAACAAACAAACCAACUC | 1016 | 3135 | GAGUUGGUUUGUUUGUUGG | 2283 |
| 3135 | CACCCAUCCAACCAAACAU | 1017 | 3135 | CACCCAUCCAACCAAACAU | 1017 | 3153 | AUGUUUGGUUGGAUGGGUG | 2284 |
| 3153 | UCUAUACGCCAAUCAGCCA | 1018 | 3153 | UCUAUACGCCAAUCAGCCA | 1018 | 3171 | UGGCUGAUUGGCGUAUAGA | 2285 |
| 3171 | AAUCCAAAACUAGCCACCC | 1019 | 3171 | AAUCCAAAACUAGCCACCC | 1019 | 3189 | GGGUGGCUAGUUUUGGAUU | 2286 |
| 3189 | CGGAAAAAUAGAUACUAU | 1020 | 3189 | CGGAAAAAUAGAUACUAU | 1020 | 3207 | AUAGUAUCUAUUUUUCCG | 2287 |
| 3207 | UAGUUACAAAAAAGAUGG | 1021 | 3207 | UAGUUACAAAAAAGAUGG | 1021 | 3225 | CCAUCUUUUUUGUAACUA | 2288 |
| 3243 | ACGUGAACAAACUUCACGA | 1022 | 3243 | ACGUGAACAAACUUCACGA | 1022 | 3261 | UCGUGAAGUUUGUUCACGU | 2289 |
| 3351 | AAUCAUCCAUGCCAGCAGA | 1023 | 3351 | AAUCAUCCAUGCCAGCAGA | 1023 | 3369 | UCUGCUGGCAUGGAUGAUU | 2290 |
| 3495 | UUACCAUAUGUGCCAAUGU | 1024 | 3495 | UUACCAUAUGUGCCAAUGU | 1024 | 3513 | ACAUUGGCACAUAUGGUAA | 2291 |
| 3531 | GCAAGCUGGCAUAUGAUGU | 1025 | 3531 | GCAAGCUGGCAUAUGAUGU | 1025 | 3549 | ACAUCAUAUGCCAGCUUGC | 2292 |
| 3621 | AAGAUCUCACUAUGAAAAC | 1026 | 3621 | AAGAUCUCACUAUGAAAAC | 1026 | 3639 | GUUUUCAUAGUGAGAUCUU | 2293 |
| 3639 | CACUCAACCCAACACAUGA | 1027 | 3639 | CACUCAACCCAACACAUGA | 1027 | 3657 | UCAUGUGUUGGGUUGAGUG | 2294 |
| 3657 | ACAUCAUUGCUUUAUGUGA | 1028 | 3657 | ACAUCAUUGCUUUAUGUGA | 1028 | 3675 | UCACAUAAAGCAAUGAUGU | 2295 |
| 3675 | AAUUUGAAAAUAUAGUAAC | 1029 | 3675 | AAUUUGAAAAUAUAGUAAC | 1029 | 3693 | GUUACUAUAUUUUCAAAUU | 2296 |
| 3783 | AAUUCAAAAAUGCCAUCAC | 1030 | 3783 | AAUUCAAAAAUGCCAUCAC | 1030 | 3801 | GUGAUGGCAUUUUUGAAUU | 2297 |
| 3819 | CUUACUCAGGAUUACUGUU | 1031 | 3819 | CUUACUCAGGAUUACUGUU | 1031 | 3837 | AACAGUAAUCCUGAGUAAG | 2298 |
| 3945 | UUACAACAAAUUGGAAGCA | 1032 | 3945 | UUACAACAAAUUGGAAGCA | 1032 | 3963 | UGCUUCCAAUUUGUUGUAA | 2299 |
| 3999 | AUUAACCUUUUUCUUCUAC | 1033 | 3999 | AUUAACCUUUUUCUUCUAC | 1033 | 4017 | GUAGAAGAAAAAGGUUAAU | 2300 |
| 4017 | CAUCAGUGAGUUGAUUCAU | 1034 | 4017 | CAUCAGUGAGUUGAUUCAU | 1034 | 4035 | AUGAAUCAACUCACUGAUG | 2301 |
| 4071 | AUAAUCACCAACCCUCUGU | 1035 | 4071 | AUAAUCACCAACCCUCUGU | 1035 | 4089 | ACAGAGGGUUGGUGAUUAU | 2302 |
| 4089 | UGGUUCAACUAAUCAAACA | 1036 | 4089 | UGGUUCAACUAAUCAAACA | 1036 | 4107 | UGUUUGAUUAGUUGAACCA | 2303 |
| 4107 | AAAACCCAUCUGGAGCCUC | 1037 | 4107 | AAAACCCAUCUGGAGCCUC | 1037 | 4125 | GAGGCUCCAGAUGGGUUUU | 2304 |
| 4143 | UGUUCAUCAGAUCUAGUAC | 1038 | 4143 | UGUUCAUCAGAUCUAGUAC | 1038 | 4161 | GUACUAGAUCUGAUGAACA | 2305 |
| 4179 | AAUAUCCACAUGGGGCAAA | 1039 | 4179 | AAUAUCCACAUGGGGCAAA | 1039 | 4197 | UUUGCCCCAUGUGGAUAUU | 2306 |
| 4233 | UGUCAACAUAGACAAGUCA | 1040 | 4233 | UGUCAACAUAGACAAGUCA | 1040 | 4251 | UGACUUGUCUAUGUUGACA | 2307 |
| 4341 | UGAUAACAACAAUAAUCUC | 1041 | 4341 | UGAUAACAACAAUAAUCUC | 1041 | 4359 | GAGAUUAUUGUUGUUAUCA | 2308 |
| 4431 | AAACCUUUGAGCUACCAAG | 1042 | 4431 | AAACCUUUGAGCUACCAAG | 1042 | 4449 | CUUGGUAGCUCAAAGGUUU | 2309 |
| 4449 | GAGCUCGAGUCAAUACAUA | 1043 | 4449 | GAGCUCGAGUCAAUACAUA | 1043 | 4467 | UAUGUAUUGACUCGAGCUC | 2310 |
| 4467 | AGCAUUCACCAAUCUGAUG | 1044 | 4467 | AGCAUUCACCAAUCUGAUG | 1044 | 4485 | CAUCAGAUUGGUGAAUGCU | 2311 |
| 4485 | GGCACAAAACAGUAACCUU | 1045 | 4485 | GGCACAAAACAGUAACCUU | 1045 | 4503 | AAGGUUACUGUUUUGUGCC | 2312 |
| 4503 | UGCAUUUGUAAGUGAACAA | 1046 | 4503 | UGCAUUUGUAAGUGAACAA | 1046 | 4521 | UUGUUCACUUACAAAUGCA | 2313 |
| 4521 | ACCCUCACCUCUUUACAAA | 1047 | 4521 | ACCCUCACCUCUUUACAAA | 1047 | 4539 | UUUGUAAAGAGGUGAGGGU | 2314 |
| 4539 | AACCACAUCAACAUCUCAC | 1048 | 4539 | AACCACAUCAACAUCUCAC | 1048 | 4557 | GUGAGAUGUUGAUGUGGUU | 2315 |
| 4557 | CCAUGCAAGCCAUCAUCCA | 1049 | 4557 | CCAUGCAAGCCAUCAUCCA | 1049 | 4575 | UGGAUGAUGGCUUGCAUGG | 2316 |
| 4575 | AUAUUAUAAAGUAGUUAAU | 1050 | 4575 | AUAUUAUAAAGUAGUUAAU | 1050 | 4593 | AUUAACUACUUUAUAAUAU | 2317 |

TABLE II-continued

RSV siNA AND TARGET SEQUENCES

| Pos | Seq | Seq ID | UPos | Upper seq | Seq ID | LPos | Lower seq | Seq ID |
|---|---|---|---|---|---|---|---|---|
| 4593 | UUAAAAAUAAUCAUAACAA | 1051 | 4593 | UUAAAAAUAAUCAUAACAA | 1051 | 4611 | UUGUUAUGAUUAUUUUAA | 2318 |
| 4611 | AUGAACUAAGAUAUUAAGA | 1052 | 4611 | AUGAACUAAGAUAUUAAGA | 1052 | 4629 | UCUUAAUAUCUUAGUUCAU | 2319 |
| 4719 | AAUCAUCUAUUAUUCAUAU | 1053 | 4719 | AAUCAUCUAUUAUUCAUAU | 1053 | 4737 | AUAUGAAUAAUAGAUGAUU | 2320 |
| 4737 | UCAUCGUGCUUAUACAAGU | 1054 | 4737 | UCAUCGUGCUUAUACAAGU | 1054 | 4755 | ACUUGUAUAAGCACGAUGA | 2321 |
| 4935 | CAGAAUCCCCAGCUUGGAA | 1055 | 4935 | CAGAAUCCCCAGCUUGGAA | 1055 | 4953 | UUCCAAGCUGGGGAUUCUG | 2322 |
| 4971 | UCUGAAACUACAUCACAAA | 1056 | 4971 | UCUGAAACUACAUCACAAA | 1056 | 4989 | UUUGUGAUGUAGUUUCAGA | 2323 |
| 5007 | UCAACAACACCAAGUGUCA | 1057 | 5007 | UCAACAACACCAAGUGUCA | 1057 | 5025 | UGACACUUGGUGUUGUUGA | 2324 |
| 5061 | AACACAACAACAACCAAAA | 1058 | 5061 | AACACAACAACAACCAAAA | 1058 | 5079 | UUUUGGUUGUUGUUGUGUU | 2325 |
| 5079 | AUACAACCCAGCAAGCCCA | 1059 | 5079 | AUACAACCCAGCAAGCCCA | 1059 | 5097 | UGGGCUUGCUGGGUUGUAU | 2326 |
| 5169 | GUACCUUGCAGCAUAUGCA | 1060 | 5169 | GUACCUUGCAGCAUAUGCA | 1060 | 5187 | UGCAUAUGCUGCAAGGUAC | 2327 |
| 5205 | UGGGCUAUCUGUAAAAGAA | 1061 | 5205 | UGGGCUAUCUGUAAAAGAA | 1061 | 5223 | UUCUUUUACAGAUAGCCCA | 2328 |
| 5223 | AUACCAAACAAAAAACCUG | 1062 | 5223 | AUACCAAACAAAAAACCUG | 1062 | 5241 | CAGGUUUUUUGUUUGGUAU | 2329 |
| 5277 | ACCAUCAAGACAACCAAAA | 1063 | 5277 | ACCAUCAAGACAACCAAAA | 1063 | 5295 | UUUUGGUUGUCUUGAUGGU | 2330 |
| 5313 | ACCACAAAACCAAAGGAAG | 1064 | 5313 | ACCACAAAACCAAAGGAAG | 1064 | 5331 | CUUCCUUUGGUUUUGUGGU | 2331 |
| 5331 | GUACCUACCACCAAGCCCA | 1065 | 5331 | GUACCUACCACCAAGCCCA | 1065 | 5349 | UGGGCUUGGUGGUAGGUAC | 2332 |
| 5349 | ACAGAAAAGCCAACCAUCA | 1066 | 5349 | ACAGAAAAGCCAACCAUCA | 1066 | 5367 | UGAUGGUUGGCUUUUCUGU | 2333 |
| 5385 | AUCAGAACUACACUGCUCA | 1067 | 5385 | AUCAGAACUACACUGCUCA | 1067 | 5403 | UGAGCAGUGUAGUUCUGAU | 2334 |
| 5403 | ACCAACAAUACCACAGGAA | 1068 | 5403 | ACCAACAAUACCACAGGAA | 1068 | 5421 | UUCCUGUGGUAUUGUUGGU | 2335 |
| 5421 | AAUCCAGAACACACAAGUC | 1069 | 5421 | AAUCCAGAACACACAAGUC | 1069 | 5439 | GACUUGUGUGUUCUGGAUU | 2336 |
| 5439 | CAAAAGGGAACCCUCCACU | 1070 | 5439 | CAAAAGGGAACCCUCCACU | 1070 | 5457 | AGUGGAGGGUUCCCUUUUG | 2337 |
| 5457 | UCAACCUCCUCCGAUGGCA | 1071 | 5457 | UCAACCUCCUCCGAUGGCA | 1071 | 5475 | UGCCAUCGGAGGAGGUUGA | 2338 |
| 5475 | AAUCCAAGCCCUUCACAAG | 1072 | 5475 | AAUCCAAGCCCUUCACAAG | 1072 | 5493 | CUUGUGAAGGGCUUGGAUU | 2339 |
| 5493 | GUCUAUACAACAUCCGAGU | 1073 | 5493 | GUCUAUACAACAUCCGAGU | 1073 | 5511 | ACUCGGAUGUUGUAUAGAC | 2340 |
| 5511 | UACCUAUCACAACCUCCAU | 1074 | 5511 | UACCUAUCACAACCUCCAU | 1074 | 5529 | AUGGAGGUUGUGAUAGGUA | 2341 |
| 5529 | UCUCCAUCCAACACAACAA | 1075 | 5529 | UCUCCAUCCAACACAACAA | 1075 | 5547 | UUGUUGUGUUGGAUGGAGA | 2342 |
| 5547 | AACCAGUAGUCAUUAAAAA | 1076 | 5547 | AACCAGUAGUCAUUAAAAA | 1076 | 5565 | UUUUUAAUGACUACUGGUU | 2343 |
| 5565 | AGCGUAUUAUUGCAAAAAG | 1077 | 5565 | AGCGUAUUAUUGCAAAAAG | 1077 | 5583 | CUUUUUGCAAUAAUACGCU | 2344 |
| 5583 | GCCAUGACCAAAUCAACCA | 1078 | 5583 | GCCAUGACCAAAUCAACCA | 1078 | 5601 | UGGUUGAUUUGGUCAUGGC | 2345 |
| 5601 | AGAAUCAAAAUCAACUCUG | 1079 | 5601 | AGAAUCAAAAUCAACUCUG | 1079 | 5619 | CAGAGUUGAUUUUGAUUCU | 2346 |
| 5637 | GUUGCCAAUCCUCAAAACA | 1080 | 5637 | GUUGCCAAUCCUCAAAACA | 1080 | 5655 | UGUUUUGAGGAUUGGCAAC | 2347 |
| 5655 | AAAUGCAAUUACCGCAAUC | 1081 | 5655 | AAAUGCAAUUACCGCAAUC | 1081 | 5673 | GAUUGCGGUAAUUGCAUUU | 2348 |
| 5673 | CCUUGCUGCAGUCACACUC | 1082 | 5673 | CCUUGCUGCAGUCACACUC | 1082 | 5691 | GAGUGUGACUGCAGCAAGG | 2349 |
| 5691 | CUGUUUUGCUUCCAGUCAA | 1083 | 5691 | CUGUUUUGCUUCCAGUCAA | 1083 | 5709 | UUGACUGGAAGCAAAACAG | 2350 |
| 5745 | UGCAGUCAGCAAAGGCUAU | 1084 | 5745 | UGCAGUCAGCAAAGGCUAU | 1084 | 5763 | AUAGCCUUUGCUGACUGCA | 2351 |
| 5889 | UAAAGUGCUGUAACAGAA | 1085 | 5889 | UAAAGUGCUGUAACAGAA | 1085 | 5907 | UUCUGUUACAGCACUUUUA | 2352 |
| 5925 | AAGCACACCGGCAACCAAC | 1086 | 5925 | AAGCACACCGGCAACCAAC | 1086 | 5943 | GUUGGUUGCCGGUGUGCUU | 2353 |
| 5997 | CAAAAAUACCAAUGUAACA | 1087 | 5997 | CAAAAAUACCAAUGUAACA | 1087 | 6015 | UGUUACAUUGGUAUUUUUG | 2354 |
| 6033 | AAGAAGAUUUCUUGGCUUU | 1088 | 6033 | AAGAAGAUUUCUUGGCUUU | 1088 | 6051 | AAAGCCAAGAAAUCUUCUU | 2355 |

TABLE II-continued

RSV siNA AND TARGET SEQUENCES

| Pos | Seq | Seq ID | UPos | Upper seq | Seq ID | LPos | Lower seq | Seq ID |
|---|---|---|---|---|---|---|---|---|
| 6231 | UAAACAGUUGUUACCUAUU | 1089 | 6231 | UAAACAGUUGUUACCUAUU | 1089 | 6249 | AAUAGGUAACAACUGUUUA | 2356 |
| 6249 | UGUGAACAAGCAAAGCUGU | 1090 | 6249 | UGUGAACAAGCAAAGCUGU | 1090 | 6267 | ACAGCUUUGCUUGUUCACA | 2357 |
| 6267 | UAGCAUAUCAAACAUUGAA | 1091 | 6267 | UAGCAUAUCAAACAUUGAA | 1091 | 6285 | UUCAAUGUUUGAUAUGCUA | 2358 |
| 6375 | CACUUAUAUGUUAACAAAU | 1092 | 6375 | CACUUAUAUGUUAACAAAU | 1092 | 6393 | AUUUGUUAACAUAUAAGUG | 2359 |
| 6393 | UAGUGAAUUAUUAUCAUUA | 1093 | 6393 | UAGUGAAUUAUUAUCAUUA | 1093 | 6411 | UAAUGAUAAUAAUUCACUA | 2360 |
| 6501 | CAUAAUAAAGGAGGAAGUC | 1094 | 6501 | CAUAAUAAAGGAGGAAGUC | 1094 | 6519 | GACUUCCUCCUUUAUUAUG | 2361 |
| 6537 | AUUACCACUAUAUGGUGUA | 1095 | 6537 | AUUACCACUAUAUGGUGUA | 1095 | 6555 | UACACCAUAUAGUGGUAAU | 2362 |
| 6555 | AAUAGAUACACCUUGUUGG | 1096 | 6555 | AAUAGAUACACCUUGUUGG | 1096 | 6573 | CCAACAAGGUGUAUCUAUU | 2363 |
| 6609 | AAAGGAAGGGUCCAACAUC | 1097 | 6609 | AAAGGAAGGGUCCAACAUC | 1097 | 6627 | GAUGUUGGACCCUUCCUUU | 2364 |
| 6627 | CUGUUUAACAAGAACCGAC | 1098 | 6627 | CUGUUUAACAAGAACCGAC | 1098 | 6645 | GUCGGUUCUUGUUAAACAG | 2365 |
| 6681 | UUUCUUCCCACUAGCUGAA | 1099 | 6681 | UUUCUUCCCACUAGCUGAA | 1099 | 6699 | UUCAGCUAGUGGGAAGAAA | 2366 |
| 6771 | UCUCUGCAACAUUGACAUA | 1100 | 6771 | UCUCUGCAACAUUGACAUA | 1100 | 6789 | UAUGUCAAUGUUGCAGAGA | 2367 |
| 6807 | UUGCAAAAUUAUGACUUCA | 1101 | 6807 | UUGCAAAAUUAUGACUUCA | 1101 | 6825 | UGAAGUCAUAAUUUUGCAA | 2368 |
| 6951 | UUAUGUAUCAAAUAAGGGG | 1102 | 6951 | UUAUGUAUCAAAUAAGGGG | 1102 | 6969 | CCCCUUAUUUGAUACAUAA | 2369 |
| 6987 | AGGUAAUACAUUAUAUUAU | 1103 | 6987 | AGGUAAUACAUUAUAUUAU | 1103 | 7005 | AUAAUAUAAUGUAUUACCU | 2370 |
| 7059 | UUUCUAUGACCCAUUAGUG | 1104 | 7059 | UUUCUAUGACCCAUUAGUG | 1104 | 7077 | CACUAAUGGGUCAUAGAAA | 2371 |
| 7077 | GUUCCCCUCUGAUGAAUUU | 1105 | 7077 | GUUCCCCUCUGAUGAAUUU | 1105 | 7095 | AAAUUCAUCAGAGGGGAAC | 2372 |
| 7257 | UGCCGUUGGACUGCUCCUA | 1106 | 7257 | UGCCGUUGGACUGCUCCUA | 1106 | 7275 | UAGGAGCAGUCCAACGGCA | 2373 |
| 7275 | AUACUGCAAGGCCAGAAGC | 1107 | 7275 | AUACUGCAAGGCCAGAAGC | 1107 | 7293 | GCUUCUGGCCUUGCAGUAU | 2374 |
| 7383 | UACAAUGGUUUCAUAUCUG | 1108 | 7383 | UACAAUGGUUUCAUAUCUG | 1108 | 7401 | CAGAUAUGAAACCAUUGUA | 2375 |
| 7473 | AUCUCACUUACAUUAUUUA | 1109 | 7473 | AUCUCACUUACAUUAUUUA | 1109 | 7491 | UAAAUAAUGUAAGUGAGAU | 2376 |
| 7509 | UAGUUAUAUAAAACAAUUG | 1110 | 7509 | UAGUUAUAUAAAACAAUUG | 1110 | 7527 | CAAUUGUUUUAUAUAACUA | 2377 |
| 7545 | CUAUUUGUAAAAAUGAGA | 1111 | 7545 | CUAUUUGUAAAAAUGAGA | 1111 | 7563 | UCUCAUUUUUACAAAUAG | 2378 |
| 7617 | UUGCUUGAAUGGUAAGAGG | 1112 | 7617 | UUGCUUGAAUGGUAAGAGG | 1112 | 7635 | CCUCUUACCAUUCAAGCAA | 2379 |
| 7779 | AACAGAAGAGUAUGCCCUC | 1113 | 7779 | AACAGAAGAGUAUGCCCUC | 1113 | 7797 | GAGGGCAUACUCUUCUGUU | 2380 |
| 7797 | CGGUGUAGUUGGAGUGCUA | 1114 | 7797 | CGGUGUAGUUGGAGUGCUA | 1114 | 7815 | UAGCACUCCAACUACACCG | 2381 |
| 7815 | AGAGAGUUAUAUAGGAUCU | 1115 | 7815 | AGAGAGUUAUAUAGGAUCU | 1115 | 7833 | AGAUCCUAUAUAACUCUCU | 2382 |
| 7833 | UAUAAAUAAUAUAACUAAA | 1116 | 7833 | UAUAAAUAAUAUAACUAAA | 1116 | 7851 | UUUAGUUAUAUUAUUUAUA | 2383 |
| 7887 | UGAACUCAACAGUGAUGAC | 1117 | 7887 | UGAACUCAACAGUGAUGAC | 1117 | 7905 | GUCAUCACUGUUGAGUUCA | 2384 |
| 7905 | CAUCAAAAACUGAGGGAC | 1118 | 7905 | CAUCAAAAACUGAGGGAC | 1118 | 7923 | GUCCCUCAGUUUUUGAUG | 2385 |
| 7923 | CAAUGAAGAGCCAAAUUCA | 1119 | 7923 | CAAUGAAGAGCCAAAUUCA | 1119 | 7941 | UGAAUUGGCUCUUCAUUG | 2386 |
| 8049 | GAAAACCAUAAAAACCACA | 1120 | 8049 | GAAAACCAUAAAAACCACA | 1120 | 8067 | UGUGGUUUUAUGGUUUUC | 2387 |
| 8067 | AUUGGAUAUCCACAAGAGC | 1121 | 8067 | AUUGGAUAUCCACAAGAGC | 1121 | 8085 | GCUCUUGUGGAUAUCCAAU | 2388 |
| 8085 | CAUAACCAUCAAUAACCCA | 1122 | 8085 | CAUAACCAUCAAUAACCCA | 1122 | 8103 | UGGGUUAUUGAUGGUUAUG | 2389 |
| 8121 | UGAUAUAAACGACCAUGCC | 1123 | 8121 | UGAUAUAAACGACCAUGCC | 1123 | 8139 | GGCAUGGUCGUUUAUAUCA | 2390 |
| 8175 | GUAUAAAUUCCAUACUAAU | 1124 | 8175 | GUAUAAAUUCCAUACUAAU | 1124 | 8193 | AUUAGUAUGGAAUUUAUAC | 2391 |
| 8193 | UAACAAGUAGUUGUAGAGU | 1125 | 8193 | UAACAAGUAGUUGUAGAGU | 1125 | 8211 | ACUCUACAACUACUUGUUA | 2392 |

TABLE II-continued

RSV siNA AND TARGET SEQUENCES

| Pos | Seq | Seq ID | UPos | Upper seq | Seq ID | LPos | Lower seq | Seq ID |
|---|---|---|---|---|---|---|---|---|
| 8247 | AUCAAAACAACCAAAAUAA | 1126 | 8247 | AUCAAAACAACCAAAAUAA | 1126 | 8265 | UUAUUUUGGUUGUUUUGAU | 2393 |
| 8265 | ACCAUAUAUACUCACCGAA | 1127 | 8265 | ACCAUAUAUACUCACCGAA | 1127 | 8283 | UUCGGUGAGUAUAUAUGGU | 2394 |
| 8283 | AUCAACCAUUCAAUGAAAU | 1128 | 8283 | AUCAACCAUUCAAUGAAAU | 1128 | 8301 | AUUUCAUUGAAUGGUUGAU | 2395 |
| 8319 | ACUUGAUUGAUGCAAUUCA | 1129 | 8319 | ACUUGAUUGAUGCAAUUCA | 1129 | 8337 | UGAAUUGCAUCAAUCAAGU | 2396 |
| 8355 | UAGGUAUUACUGAUGAUAU | 1130 | 8355 | UAGGUAUUACUGAUGAUAU | 1130 | 8373 | AUAUCAUCAGUAAUACCUA | 2397 |
| 8373 | UAUACACAAUAUAUAUAUU | 1131 | 8373 | UAUACACAAUAUAUAUAUU | 1131 | 8391 | AAUAUAUAUAUUGUGUAUA | 2398 |
| 8409 | UCCUAAUGCUUACCACAUC | 1132 | 8409 | UCCUAAUGCUUACCACAUC | 1132 | 8427 | GAUGUGGUAAGCAUUAGGA | 2399 |
| 8427 | CAUCAAACUAUUAACUCAA | 1133 | 8427 | CAUCAAACUAUUAACUCAA | 1133 | 8445 | UUGAGUUAAUAGUUUGAUG | 2400 |
| 8445 | AACAAUUCAAGCCAUGGGA | 1134 | 8445 | AACAAUUCAAGCCAUGGGA | 1134 | 8463 | UCCCAUGGCUUGAAUUGUU | 2401 |
| 8499 | AUGUGUAUCUAACCGAUAG | 1135 | 8499 | AUGUGUAUCUAACCGAUAG | 1135 | 8517 | CUAUCGGUUAGAUACACAU | 2402 |
| 8535 | UUUCUUUCUCAGAAUGUAA | 1136 | 8535 | UUUCUUUCUCAGAAUGUAA | 1136 | 8553 | UUACAUUCUGAGAAAGAAA | 2403 |
| 8643 | UAAAUCUAAAGAAACUAAA | 1137 | 8643 | UAAAUCUAAAGAAACUAAA | 1137 | 8661 | UUUAGUUUCUUUAGAUUUA | 2404 |
| 8697 | GUGAAAUAAAAAUAGAAGA | 1138 | 8697 | GUGAAAUAAAAAUAGAAGA | 1138 | 8715 | UCUUCUAUUUUUAUUUCAC | 2405 |
| 8751 | AGAGUAUGACCUCGUUAGA | 1139 | 8751 | AGAGUAUGACCUCGUUAGA | 1139 | 8769 | UCUAACGAGGUCAUACUCU | 2406 |
| 8769 | AACAGAUUACUACCACUAA | 1140 | 8769 | AACAGAUUACUACCACUAA | 1140 | 8787 | UUAGUGGUAGUAAUCUGUU | 2407 |
| 8823 | UUAGUGAUGUCAAAGUCUA | 1141 | 8823 | UUAGUGAUGUCAAAGUCUA | 1141 | 8841 | UAGACUUUGACAUCACUAA | 2408 |
| 8859 | UGGGGCUUAAAGAAAAAGA | 1142 | 8859 | UGGGGCUUAAAGAAAAAGA | 1142 | 8877 | UCUUUUUCUUUAAGCCCCA | 2409 |
| 8913 | ACUCAGUUAUUACAACCAU | 1143 | 8913 | ACUCAGUUAUUACAACCAU | 1143 | 8931 | AUGGUUGUAAUAACUGAGU | 2410 |
| 8949 | UUUUAGCUGUUAAGGAUAA | 1144 | 8949 | UUUUAGCUGUUAAGGAUAA | 1144 | 8967 | UUAUCCUUAACAGCUAAAA | 2411 |
| 8985 | CAGUCAAAAAUCACUCUAC | 1145 | 8985 | CAGUCAAAAAUCACUCUAC | 1145 | 9003 | GUAGAGUGAUUUUUGACUG | 2412 |
| 9003 | CAAAACAAAAAGAUACAAU | 1146 | 9003 | CAAAACAAAAAGAUACAAU | 1146 | 9021 | AUUGUAUCUUUUUGUUUUG | 2413 |
| 9129 | AUCGAUCAAGUGAGGUAAA | 1147 | 9129 | AUCGAUCAAGUGAGGUAAA | 1147 | 9147 | UUUACCUCACUUGAUCGAU | 2414 |
| 9147 | AAAACCAUGGUUUUAUAUU | 1148 | 9147 | AAAACCAUGGUUUUAUAUU | 1148 | 9165 | AAUAUAAAACCAUGGUUUU | 2415 |
| 9165 | UGAUAGACAAUCAUACUCU | 1149 | 9165 | UGAUAGACAAUCAUACUCU | 1149 | 9183 | AGAGUAUGAUUGUCUAUCA | 2416 |
| 9183 | UCAAUGGAUUCCAAUUUAU | 1150 | 9183 | UCAAUGGAUUCCAAUUUAU | 1150 | 9201 | AUAAAUUGGAAUCCAUUGA | 2417 |
| 9327 | GGAUUAGUAACUGUUUGAA | 1151 | 9327 | GGAUUAGUAACUGUUUGAA | 1151 | 9345 | UUCAAACAGUUACUAAUCC | 2418 |
| 9399 | CACAACUAUUCCUCUAUGG | 1152 | 9399 | CACAACUAUUCCUCUAUGG | 1152 | 9417 | CCAUAGAGGAAUAGUUGUG | 2419 |
| 9417 | GAGAUUGUAUACUAAAACU | 1153 | 9417 | GAGAUUGUAUACUAAAACU | 1153 | 9435 | AGUUUUAGUAUACAAUCUC | 2420 |
| 9435 | UAUUCCACAAUGAGGGGUU | 1154 | 9435 | UAUUCCACAAUGAGGGGUU | 1154 | 9453 | AACCCCUCAUUGUGGAAUA | 2421 |
| 9525 | GAAAACGUUUUAUAAUAG | 1155 | 9525 | GAAAACGGUUUUAUAAUAG | 1155 | 9543 | CUAUUAUAAAACCGUUUUC | 2422 |
| 9723 | UGAGUGAAUUAUAUUUUUU | 1156 | 9723 | UGAGUGAAUUAUAUUUUUU | 1156 | 9741 | AAAAAAUAUAAUUCACUCA | 2423 |
| 9795 | UUAAAGUUAAUUGCAACGA | 1157 | 9795 | UUAAAGUUAAUUGCAACGA | 1157 | 9813 | UCGUUGCAAUUAACUUUAA | 2424 |
| 9867 | AUAGAAUUAUAAAAGGAUU | 1158 | 9867 | AUAGAAUUAUAAAAGGAUU | 1158 | 9885 | AAUCCUUUUAUAAUUCUAU | 2425 |
| 9903 | GAUGGCCUACUUUAAGGAA | 1159 | 9903 | GAUGGCCUACUUUAAGGAA | 1159 | 9921 | UUCCUUAAAGUAGGCCAUC | 2426 |
| 9975 | CUUCCUUGUUGGAACUUAC | 1160 | 9975 | CUUCCUUGUUGGAACUUAC | 1160 | 9993 | GUAAGUUCCAACAAGGAAG | 2427 |
| 10011 | UUUUAUCAGGACUACGUUU | 1161 | 10011 | UUUUAUCAGGACUACGUUU | 1161 | 10029 | AAACGUAGUCCUGAUAAAA | 2428 |
| 10065 | UUGAAAUGAUCAUAAAUGA | 1162 | 10065 | UUGAAAUGAUCAUAAAUGA | 1162 | 10083 | UCAUUUAUGAUCAUUUCAA | 2429 |
| 10083 | AUAAGGCUAUAUCACCUCC | 1163 | 10083 | AUAAGGCUAUAUCACCUCC | 1163 | 10101 | GGAGGUGAUAUAGCCUUAU | 2430 |

TABLE II-continued

RSV siNA AND TARGET SEQUENCES

| Pos | Seq | Seq ID | UPos | Upper seq | Seq ID | LPos | Lower seq | Seq ID |
|---|---|---|---|---|---|---|---|---|
| 10209 | GAGUAUUAGAGUACUAUUU | 1164 | 10209 | GAGUAUUAGAGUACUAUUU | 1164 | 10227 | AAAUAGUACUCUAAUACUC | 2431 |
| 10281 | GUUAUCUUAACAACCCUAA | 1165 | 10281 | GUUAUCUUAACAACCCUAA | 1165 | 10299 | UUAGGGUUGUUAAGAUAAC | 2432 |
| 10299 | AUCAUGUGGUAUCUUUGAC | 1166 | 10299 | AUCAUGUGGUAUCUUUGAC | 1166 | 10317 | GUCAAAGAUACCACAUGAU | 2433 |
| 10353 | UUGCAAUGCAACCAGGAAU | 1167 | 10353 | UUGCAAUGCAACCAGGAAU | 1167 | 10371 | AUUCCUGGUUGCAUUGCAA | 2434 |
| 10371 | UGUUCAGACAAGUUCAAAU | 1168 | 10371 | UGUUCAGACAAGUUCAAAU | 1168 | 10389 | AUUUGAACUUGUCUGAACA | 2435 |
| 10389 | UAUUAGCAGAGAAAAUGAU | 1169 | 10389 | UAUUAGCAGAGAAAAUGAU | 1169 | 10407 | AUCAUUUUCUCUGCUAAUA | 2436 |
| 10461 | UAGAACUACAGAAAAUAUU | 1170 | 10461 | UAGAACUACAGAAAAUAUU | 1170 | 10479 | AAUAUUUUCUGUAGUUCUA | 2437 |
| 10515 | GUUACAAUGAUAAUUACAA | 1171 | 10515 | GUUACAAUGAUAAUUACAA | 1171 | 10533 | UUGUAAUUAUCAUUGUAAC | 2438 |
| 10587 | CAUUUCGAUAUGAAACAUC | 1172 | 10587 | CAUUUCGAUAUGAAACAUC | 1172 | 10605 | GAUGUUUCAUAUCGAAAUG | 2439 |
| 10623 | UACUGGAUGAACUGCAUGG | 1173 | 10623 | UACUGGAUGAACUGCAUGG | 1173 | 10641 | CCAUGCAGUUCAUCCAGUA | 2440 |
| 10785 | AUAUGGGUGGUAUCGAAGG | 1174 | 10785 | AUAUGGGUGGUAUCGAAGG | 1174 | 10803 | CCUUCGAUACCACCCAUAU | 2441 |
| 10911 | UAGAUAUAAGUAAACCAGU | 1175 | 10911 | UAGAUAUAAGUAAACCAGU | 1175 | 10929 | ACUGGUUUACUUAUAUCUA | 2442 |
| 10983 | AUAGUCUUAAAUUACUGUA | 1176 | 10983 | AUAGUCUUAAAUUACUGUA | 1176 | 11001 | UACAGUAAUUUAAGACUAU | 2443 |
| 11055 | CAAGAGAUAUGCAAUUUAU | 1177 | 11055 | CAAGAGAUAUGCAAUUUAU | 1177 | 11073 | AUAAAUUGCAUAUCUCUUG | 2444 |
| 11217 | AUAGAGGAGAAAGUCUAUU | 1178 | 11217 | AUAGAGGAGAAAGUCUAUU | 1178 | 11235 | AAUAGACUUUCUCCUCUAU | 2445 |
| 11271 | AUCAAAUUGCUUUACAACU | 1179 | 11271 | AUCAAAUUGCUUUACAACU | 1179 | 11289 | AGUUGUAAAGCAAUUUGAU | 2446 |
| 11397 | UGUAUAUGAAUUUGCCCAU | 1180 | 11397 | UGUAUAUGAAUUUGCCCAU | 1180 | 11415 | AUGGGCAAAUUCAUAUACA | 2447 |
| 11523 | AUACAAACCAUGAUUUAAA | 1181 | 11523 | AUACAAACCAUGAUUUAAA | 1181 | 11541 | UUUAAAUCAUGGUUUGUAU | 2448 |
| 11595 | UAAUCACAUUUGACAAAAA | 1182 | 11595 | UAAUCACAUUUGACAAAAA | 1182 | 11613 | UUUUUGUCAAAUGUGAUUA | 2449 |
| 11721 | UGAGCACAGCUCCAAACAA | 1183 | 11721 | UGAGCACAGCUCCAAACAA | 1183 | 11739 | UUGUUUGGAGCUGUGCUCA | 2450 |
| 11757 | CACAACACUAUACCACUAC | 1184 | 11757 | CACAACACUAUACCACUAC | 1184 | 11775 | GUAGUGGUAUAGUGUUGUG | 2451 |
| 11883 | AUCUUAUAUCCGGUACAAA | 1185 | 11883 | AUCUUAUAUCCGGUACAAA | 1185 | 11901 | UUUGUACCGGAUAUAAGAU | 2452 |
| 11991 | UGCUUAUAAGGAUAUUUCC | 1186 | 11991 | UGCUUAUAAGGAUAUUUCC | 1186 | 12009 | GGAAAUAUCCUUAUAAGCA | 2453 |
| 12009 | CAUUAGAUUGUAACAGAGA | 1187 | 12009 | CAUUAGAUUGUAACAGAGA | 1187 | 12027 | UCUCUGUUACAAUCUAAUG | 2454 |
| 12027 | AUAAAGGGAAAUAUUGAG | 1188 | 12027 | AUAAAGGGAAAUAUUGAG | 1188 | 12045 | CUCAAUAUUUCCCUUUUAU | 2455 |
| 12117 | UUGGUGUUACAUCACCUAG | 1189 | 12117 | UUGGUGUUACAUCACCUAG | 1189 | 12135 | CUAGGUGAUGUAACACCAA | 2456 |
| 12189 | UAAUCAUAGAGAAAUAUAA | 1190 | 12189 | UAAUCAUAGAGAAAUAUAA | 1190 | 12207 | UUAUAUUUCUCUAUGAUUA | 2457 |
| 12387 | AAUUCAUGGAAGAACUUAG | 1191 | 12387 | AAUUCAUGGAAGAACUUAG | 1191 | 12405 | CUAAGUUCUUCCAUGAAUU | 2458 |
| 12423 | UAACAUAUGAGAAAGCCAA | 1192 | 12423 | UAACAUAUGAGAAAGCCAA | 1192 | 12441 | UUGGCUUUCUCAUAUGUUA | 2459 |
| 12459 | AUUUAAGUGUUAACUAUUU | 1193 | 12459 | AUUUAAGUGUUAACUAUUU | 1193 | 12477 | AAAUAGUUAACACUUAAAU | 2460 |
| 12531 | CUUAUAGAACUACAAAUUA | 1194 | 12531 | CUUAUAGAACUACAAAUUA | 1194 | 12549 | UAAUUUGUAGUUCUAUAAG | 2461 |
| 12549 | AUCACUUUGAUACUAGCCC | 1195 | 12549 | AUCACUUUGAUACUAGCCC | 1195 | 12567 | GGGCUAGUAUCAAAGUGAU | 2462 |
| 12603 | AAGAUAUUGAUAUAGUAUU | 1196 | 12603 | AAGAUAUUGAUAUAGUAUU | 1196 | 12621 | AAUACUAUAUCAAUAUCUU | 2463 |
| 12693 | GAAUUAUUCUUAUACCUAA | 1197 | 12693 | GAAUUAUUCUUAUACCUAA | 1197 | 12711 | UUAGGUAUAAGAAUAAUUC | 2464 |
| 12729 | UAAUGAAACCUCCCAUAUU | 1198 | 12729 | UAAUGAAACCUCCCAUAUU | 1198 | 12747 | AAUAUGGGAGGUUUCAUUA | 2465 |
| 12891 | AUUUAAUAUUGGCGCAUAA | 1199 | 12891 | AUUUAAUAUUGGCGCAUAA | 1199 | 12909 | UUAUGCGCCAAUAUUAAAU | 2466 |
| 12909 | AGAUAUCUGACUAUUUUCA | 1200 | 12909 | AGAUAUCUGACUAUUUUCA | 1200 | 12927 | UGAAAAUAGUCAGAUAUCU | 2467 |

TABLE II-continued

RSV siNA AND TARGET SEQUENCES

| Pos | Seq | Seq ID | UPos | Upper seq | Seq ID | LPos | Lower seq | Seq ID |
|---|---|---|---|---|---|---|---|---|
| 12999 | AGGGUAUUUUUGAAAAAGA | 1201 | 12999 | AGGGUAUUUUUGAAAAAGA | 1201 | 13017 | UCUUUUUCAAAAAUACCCU | 2468 |
| 13107 | AAGGUUACGGCAGAGCAAA | 1202 | 13107 | AAGGUUACGGCAGAGCAAA | 1202 | 13125 | UUUGCUCUGCCGUAACCUU | 2469 |
| 13143 | AUACUUCAGAUCUCCUAUG | 1203 | 13143 | AUACUUCAGAUCUCCUAUG | 1203 | 13161 | CAUAGGAGAUCUGAAGUAU | 2470 |
| 13233 | AAUACAUUCUUAGCCAGGA | 1204 | 13233 | AAUACAUUCUUAGCCAGGA | 1204 | 13251 | UCCUGGCUAAGAAUGUAUU | 2471 |
| 13287 | UCAAACUAUGGUUUCUUAA | 1205 | 13287 | UCAAACUAUGGUUUCUUAA | 1205 | 13305 | UUAAGAAACCAUAGUUUGA | 2472 |
| 13413 | GAUUGAUAAAUAUAGAUAA | 1206 | 13413 | GAUUGAUAAAUAUAGAUAA | 1206 | 13431 | UUAUCUAUAUUUAUCAAUC | 2473 |
| 13431 | AAAUAUACAUUAAAAAUAA | 1207 | 13431 | AAAUAUACAUUAAAAAUAA | 1207 | 13449 | UUAUUUUUAAUGUAUAUUU | 2474 |
| 13593 | CACCAGAAACCCUAGAAAA | 1208 | 13593 | CACCAGAAACCCUAGAAAA | 1208 | 13611 | UUUUCUAGGGUUUCUGGUG | 2475 |
| 13611 | AUAUACUAACCAAUCCGGU | 1209 | 13611 | AUAUACUAACCAAUCCGGU | 1209 | 13629 | ACCGGAUUGGUUAGUAUAU | 2476 |
| 13629 | UUAAAUGUAAUGACAAAAA | 1210 | 13629 | UUAAAUGUAAUGACAAAAA | 1210 | 13647 | UUUUUGUCAUUACAUUUAA | 2477 |
| 13773 | AUUUAUUCCUACGGUUGU | 1211 | 13773 | AUUUAUUUCCUACGGUUGU | 1211 | 13791 | ACAACCGUAGGAAAUAAAU | 2478 |
| 13791 | UGAUUGAUAAAAUUAUAGA | 1212 | 13791 | UGAUUGAUAAAAUUAUAGA | 1212 | 13809 | UCUAUAAUUUUAUCAAUCA | 2479 |
| 13827 | CCAAAUCUAACCAACUUUA | 1213 | 13827 | CCAAAUCUAACCAACUUUA | 1213 | 13845 | UAAAGUUGGUUAGAUUUGG | 2480 |
| 13845 | ACACUACUACUUCUCAUCA | 1214 | 13845 | ACACUACUACUUCUCAUCA | 1214 | 13863 | UGAUGAGAAGUAGUAGUGU | 2481 |
| 13863 | AAAUACCUUUAGUGCACAA | 1215 | 13863 | AAAUACCUUUAGUGCACAA | 1215 | 13881 | UUGUGCACUAAAGGUAUUU | 2482 |
| 14277 | CUGAAUUGCCUGUAACAGU | 1216 | 14277 | CUGAAUUGCCUGUAACAGU | 1216 | 14295 | ACUGUUACAGGCAAUUCAG | 2483 |
| 14313 | UAAUAGAGUGGAGCAAGCA | 1217 | 14313 | UAAUAGAGUGGAGCAAGCA | 1217 | 14331 | UGCUUGCUCCACUCUAUUA | 2484 |
| 14403 | AUAUCGAUUUCAAAUUAGA | 1218 | 14403 | AUAUCGAUUUCAAAUUAGA | 1218 | 14421 | UCUAAUUUGAAAUCGAUAU | 2485 |
| 14457 | GCAGUAAGUUAAAGGGGUC | 1219 | 14457 | GCAGUAAGUUAAAGGGGUC | 1219 | 14475 | GACCCCUUUAACUUACUGC | 2486 |
| 14511 | AUGUGUUCCCAGUAUUUAA | 1220 | 14511 | AUGUGUUCCCAGUAUUUAA | 1220 | 14529 | UUAAAUACUGGGAACACAU | 2487 |
| 14583 | CUAAGAAGGCUGAUAAAGA | 1221 | 14583 | CUAAGAAGGCUGAUAAAGA | 1221 | 14601 | UCUUUAUCAGCCUUCUUAG | 2488 |
| 14727 | UAGCAGGACGUAAUGAAGU | 1222 | 14727 | UAGCAGGACGUAAUGAAGU | 1222 | 14745 | ACUUCAUUACGUCCUGCUA | 2489 |
| 14835 | AUAAUCAUUUAUAUAUGGU | 1223 | 14835 | AUAAUCAUUUAUAUAUGGU | 1223 | 14853 | ACCAUAUAUAAAUGAUUAU | 2490 |
| 14871 | AUCUAAGUGAAUUGUUAAA | 1224 | 14871 | AUCUAAGUGAAUUGUUAAA | 1224 | 14889 | UUUAACAAUUCACUUAGAU | 2491 |
| 14925 | AAAUCACAGGUAGUUUGUU | 1225 | 14925 | AAAUCACAGGUAGUUUGUU | 1225 | 14943 | AACAAACUACCUGUGAUUU | 2492 |
| 14961 | AAUAAUGAAUAAAAAUCUU | 1226 | 14961 | AAUAAUGAAUAAAAAUCUU | 1226 | 14979 | AAGAUUUUUAUUCAUUAUU | 2493 |
| 14979 | UAUAUUAAAAAUUCCCAUA | 1227 | 14979 | UAUAUUAAAAAUUCCCAUA | 1227 | 14997 | UAUGGGAAUUUUUAAUAUA | 2494 |
| 14997 | AGCUACACACUAACACUGU | 1228 | 14997 | AGCUACACACUAACACUGU | 1228 | 15015 | ACAGUGUUAGUGUGUAGCU | 2495 |
| 15051 | AAUUUUUUAAUAACUUUUA | 1229 | 15051 | AAUUUUUUAAUAACUUUUA | 1229 | 15069 | UAAAAGUUAUUAAAAAAUU | 2496 |
| 15069 | AGUGAACUAAUCCUAAAAU | 1230 | 15069 | AGUGAACUAAUCCUAAAAU | 1230 | 15087 | AUUUUAGGAUUAGUUCACU | 2497 |
| 15105 | AGGAAUAAAUUUAAAUCCA | 1231 | 15105 | AGGAAUAAAUUUAAAUCCA | 1231 | 15123 | UGGAUUUAAAUUUAUUCCU | 2498 |
| 15123 | AAAUCUAAUUGGUUUAUAU | 1232 | 15123 | AAAUCUAAUUGGUUUAUAU | 1232 | 15141 | AUAUAAACCAAUUAGAUUU | 2499 |
| 15141 | UGUAUAUUAACUAAACUAC | 1233 | 15141 | UGUAUAUUAACUAAACUAC | 1233 | 15159 | GUAGUUUAGUUAAUAUACA | 2500 |
| 201 | AUACAUUUAACUAAUGCAU | 1234 | 201 | AUACAUUUAACUAAUGCAU | 1234 | 219 | AUGCAUUAGUUAAAUGUAU | 2501 |
| 255 | GGCAUUGUAUUUGUGCAUG | 1235 | 255 | GGCAUUGUAUUUGUGCAUG | 1235 | 273 | CAUGCACAAAUACAAUGCC | 2502 |
| 309 | AUUGUAGUGAAAUCCAAUU | 1236 | 309 | AUUGUAGUGAAAUCCAAUU | 1236 | 327 | AAUUGGAUUUCACUACAAU | 2503 |
| 327 | UUCACAACAAUGCCAGUGU | 1237 | 327 | UUCACAACAAUGCCAGUGU | 1237 | 345 | ACACUGGCAUUGUUGUGAA | 2504 |
| 345 | UUACAAAAUGGAGGUUAUA | 1238 | 345 | UUACAAAAUGGAGGUUAUA | 1238 | 363 | UAUAACCUCCAUUUUGUAA | 2505 |

TABLE II-continued

RSV siNA AND TARGET SEQUENCES

| Pos | Seq | Seq ID | UPos | Upper seq | Seq ID | LPos | Lower seq | Seq ID |
|---|---|---|---|---|---|---|---|---|
| 381 | UUAACACACUGCUCUCAAC | 1239 | 381 | UUAACACACUGCUCUCAAC | 1239 | 399 | GUUGAGAGCAGUGUGUUAA | 2506 |
| 399 | CCUAAUGGCCUAAUAGAUG | 1240 | 399 | CCUAAUGGCCUAAUAGAUG | 1240 | 417 | CAUCUAUUAGGCCAUUAGG | 2507 |
| 1443 | CAAGAUAUUAAUGGGAAAG | 1241 | 1443 | CAAGAUAUUAAUGGGAAAG | 1241 | 1461 | CUUUCCCAUUAAUAUCUUG | 2508 |
| 2325 | AAAAAUGGGGCAAAUAAAA | 1242 | 2325 | AAAAAUGGGGCAAAUAAAA | 1242 | 2343 | UUUUAUUUGCCCCAUUUUU | 2509 |
| 2343 | ACAUCAUGGAAAAGUUUGC | 1243 | 2343 | ACAUCAUGGAAAAGUUUGC | 1243 | 2361 | GCAAACUUUUCCAUGAUGU | 2510 |
| 2865 | UAAGAGAAGACAUGAUAGA | 1244 | 2865 | UAAGAGAAGACAUGAUAGA | 1244 | 2883 | UCUAUCAUGUCUUCUCUUA | 2511 |
| 3423 | CACCCAAUGGACCUUCAUU | 1245 | 3423 | CACCCAAUGGACCUUCAUU | 1245 | 3441 | AAUGAAGGUCCAUUGGGUG | 2512 |
| 4251 | AACACGCCAGGCAAAAUCA | 1246 | 4251 | AACACGCCAGGCAAAAUCA | 1246 | 4269 | UGAUUUUGCCUGGCGUGUU | 2513 |
| 4395 | UGAACAAACUCUGUGAAUA | 1247 | 4395 | UGAACAAACUCUGUGAAUA | 1247 | 4413 | UAUUCACAGAGUUUGUUCA | 2514 |
| 4683 | ACCACCAAGACACUAGAAA | 1248 | 4683 | ACCACCAAGACACUAGAAA | 1248 | 4701 | UUUCUAGUGUCUUGGUGGU | 2515 |
| 5727 | UUAUCAAACAACAUGCAGU | 1249 | 5727 | UUAUCAAACAACAUGCAGU | 1249 | 5745 | ACUGCAUGUUGUUUGAUAA | 2516 |
| 5835 | GUGUAAUGGAACAGACGCU | 1250 | 5835 | GUGUAAUGGAACAGACGCU | 1250 | 5853 | AGCGUCUGUUCCAUUACAC | 2517 |
| 6123 | GAACAAAAUCAAAAGUGCU | 1251 | 6123 | GAACAAAAUCAAAAGUGCU | 1251 | 6141 | AGCACUUUUGAUUUUGUUC | 2518 |
| 6573 | GAAACUGCACACAUCCCCU | 1252 | 6573 | GAAACUGCACACAUCCCCU | 1252 | 6591 | AGGGGAUGUGUGCAGUUUC | 2519 |
| 6969 | GGUUGACACUGUGUCUGUA | 1253 | 6969 | GGUUGACACUGUGUCUGUA | 1253 | 6987 | UACAGACACAGUGUCAACC | 2520 |
| 7725 | GGAUAAAAGCAUCGAUACU | 1254 | 7725 | GGAUAAAAGCAUCGAUACU | 1254 | 7743 | AGUAUCGAUGCUUUUAUCC | 2521 |
| 7743 | UUUAUCAGAAAUAAGUGGA | 1255 | 7743 | UUUAUCAGAAAUAAGUGGA | 1255 | 7761 | UCCACUUAUUUCUGAUAAA | 2522 |
| 8679 | UGUCUAAGUAUCAUAAAGG | 1256 | 8679 | UGUCUAAGUAUCAUAAAGG | 1256 | 8697 | CCUUUAUGAUACUUAGACA | 2523 |
| 9273 | UCUUGACAUGGAAAAAUAU | 1257 | 9273 | UCUUGACAUGGAAAAAUAU | 1257 | 9291 | AUAUUUUCCAUGUCAAGA | 2524 |
| 10641 | GUGUACAAUCUCUAUUUUU | 1258 | 10641 | GUGUACAAUCUCUAUUUUU | 1258 | 10659 | AAAAAUAGAGAUUGUACAC | 2525 |
| 10659 | UCUGGUUACAUUUAGCUAU | 1259 | 10659 | UCUGGUUACAUUUAGCUAU | 1259 | 10677 | AUAGCUAAAUGUAACCAGA | 2526 |
| 11703 | UGGCAGUUACUGAGGUUUU | 1260 | 11703 | UGGCAGUUACUGAGGUUUU | 1260 | 11721 | AAAACCUCAGUAACUGCCA | 2527 |
| 12405 | GCAUAGGAAUUCUUGGGUU | 1261 | 12405 | GCAUAGGAAUUCUUGGGUU | 1261 | 12423 | AACCCAAGAAUUCCUAUGC | 2528 |
| 13719 | UUAUUAAAUCGCCUACAAU | 1262 | 13719 | UUAUUAAAUCGCCUACAAU | 1262 | 13737 | AUUGUAGGCGAUUUAAUAA | 2529 |
| 13989 | UUAUAAUUAAAGAUCCUAA | 1263 | 13989 | UUAUAAUUAAAGAUCCUAA | 1263 | 14007 | UUAGGAUCUUUAAUUAUAA | 2530 |
| 14061 | UGGAACUUCAUCCCGAUAU | 1264 | 14061 | UGGAACUUCAUCCCGAUAU | 1264 | 14079 | AUAUCGGGAUGAAGUUCCA | 2531 |
| 14097 | GUCUGAAGGAUUGCAAUGA | 1265 | 14097 | GUCUGAAGGAUUGCAAUGA | 1265 | 14115 | UCAUUGCAAUCCUUCAGAC | 2532 |
| 15015 | UAUUCAAUUAUAGUUAUUU | 1266 | 15015 | UAUUCAAUUAUAGUUAUUU | 1266 | 15033 | AAAUAACUAUAAUUGAAUA | 2533 |
| 15033 | UAAAAUUAAAAAUUAUAUA | 1267 | 15033 | UAAAAUUAAAAAUUAUAUA | 1267 | 15051 | UAUAUAAUUUUUAAUUUUA | 2534 |

Figure 4:
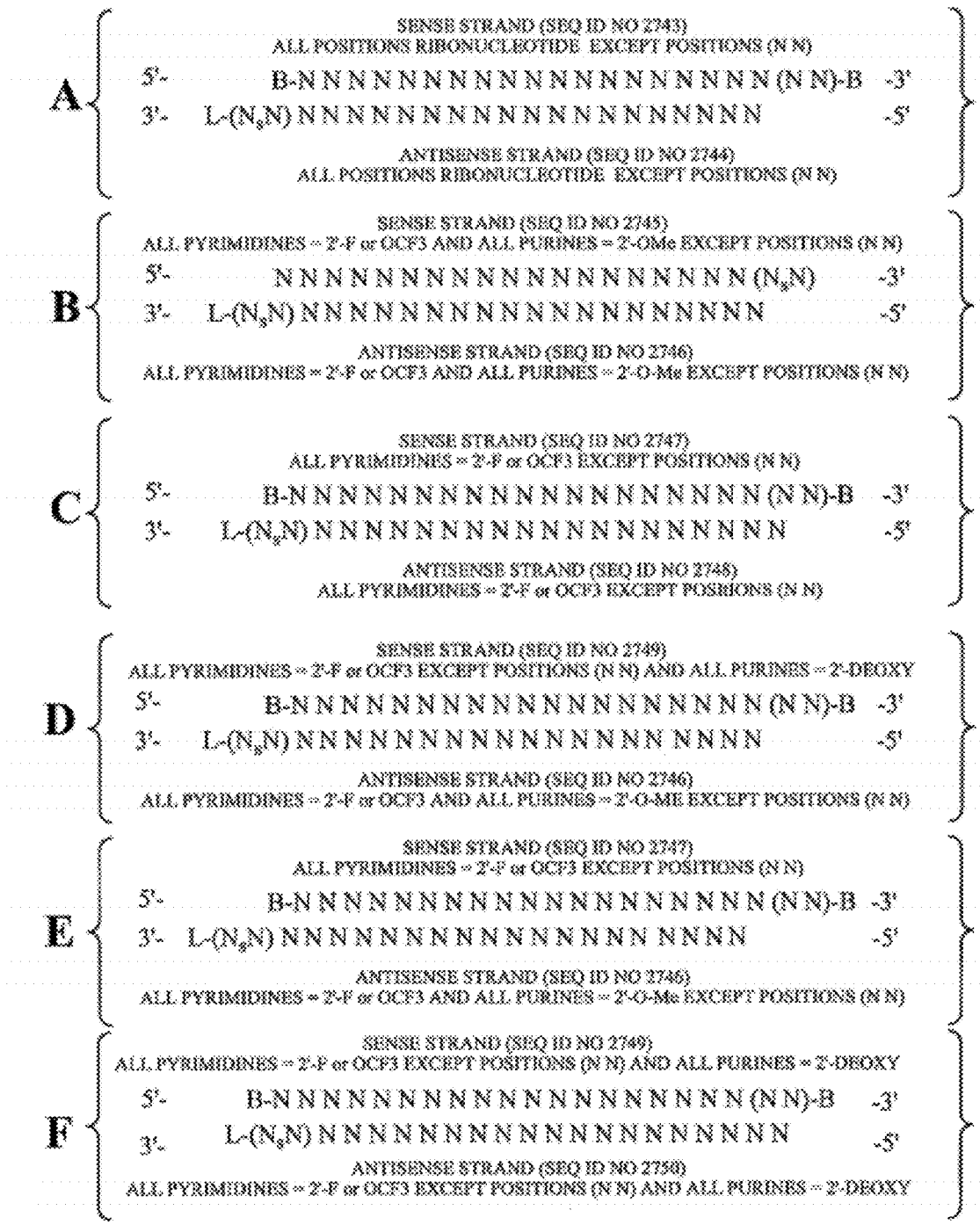
FIG. 4A-F shows non-limiting examples of chemically-modified siNA constructs of the present invention. In the figure, N stands for any nucleotide (adenosine, guanosine, cytosine, uridine, or optionally thymidine, for example thymidine can be substituted in the overhanging regions designated by parenthesis (N N). Various modifications are shown for the sense and antisense strands of the siNA constructs. The (N N) nucleotide positions can be chemically modified as described herein (e.g., 2'-O-methyl, 2'-deoxy-2'-fluoro etc.) and can be either derived from a corresponding target nucleic acid sequence or not (see for example FIG. 6C). Furthermore, the sequences shown in FIG. 4 can optionally include a ribonucleotide at the $9^{th}$ position from the 5'-end of the sense strand or the $11^{th}$ position based on the 5'-end of the guide strand by counting 11 nucleotide positions in from the 5'-terminus of the guide strand (see FIG. 6C).
Figure 5:
FIG. 5A-F shows non-limiting examples of specific chemically-modified siNA sequences of the invention. A-F applies the chemical modifications described in FIG. 4A-F to an exemplary RSV siNA sequence. Such chemical modifications can be applied to any RSV sequence and/or cellular target sequence. Furthermore, the sequences shown in FIG. 5 can optionally include a ribonucleotide at the $9^{th}$ position from the 5'-end of the sense strand or the $11^{th}$ position based on the 5'-end of the guide strand by counting 11 nucleotide positions in from the 5'-terminus of the guide strand (see FIG. 6C). In addition, the sequences shown in FIG. 5 can optionally include terminal ribonucleotides at up to about 4 positions at the 5'-end of the antisense strand (e.g., about 1, 2, 3, or 4 terminal ribonucleotides at the 5'-end of the antisense strand).

The 3'-ends of the Upper sequence and the Lower sequence of the siNA construct can include an overhang sequence, for example about 1, 2, 3, or 4 nucleotides in length, preferably 2 nucleotides in length, wherein the overhanging sequence of the lower sequence is optionally complementary to a portion of the target sequence. The upper sequence is also referred to as the sense strand, whereas the lower sequence is also referred to as the antisense strand. The upper and lower sequences in the Table canfurther comprise a chemical modification having Formulae I-VII, such as exemplary siNA constructs shown in FIGS. 4 and 5, or having modifications described in Table IV or any combination thereof.

TABLE III

| Target Pos | Target | Seq ID | Cmpd# | Aliases | Sequence | Seq ID |
|---|---|---|---|---|---|---|
| | | | | RSV Synthetic Modified siNA Constructs | | |
| 9524 | AACUUGCGUAAACCAAAAAAAUG | 2535 | | RSV: 27U21 SENSE siNA | CUUGCGUAAACCAAAAAAATT | 2639 |
| 1467 | UGGGGCAAAUAAGAAUUUGAUAA | 2536 | | RSV: 48U21 SENSE siNA | GGGCAAAUAAGAAUUUGAUTT | 2640 |
| 5090 | UUCUCCAAAAAACUAAGUGAUUC | 2537 | | RSV: 439U21 SENSE siNA | CUCCAAAAAACUAAGUGAUTT | 2641 |
| 7837 | CUGGUCAACUAUGAAAUGAAACU | 2538 | | RSV: 815U21 SENSE siNA | GGUCAACUAUGAAAUGAAATT | 2642 |
| 1468 | GGGAAGCACUAAAUACAAAAAAU | 2539 | | RSV: 850U21 SENSE siNA | GAAGCACUAAAUACAAAAATT | 2643 |
| 6758 | CACUCCCAUAAUAUACAAGUAUG | 2540 | | RSV: 970U21 SENSE siNA | CUCCCAUAAUAUACAAGUATT | 2644 |
| 3973 | GUCAUCCAGCAAAUACACCAUCC | 2541 | | RSV: 1197U21 SENSE siNA | CAUCCAGCAAAUACACCAUTT | 2645 |
| 3615 | AACAGCUUCUAUGAAGUGUUUGA | 2542 | | RSV: 1762U21 SENSE siNA | CAGCUUCUAUGAAGUGUUUTT | 2646 |
| 9524 | AACUUGCGUAAACCAAAAAAAUG | 2535 | | RSV: 45L21 ANTISENSE siNA (27C) | UUUUUUUGGUUUACGCAAGTT | 2647 |
| 1467 | UGGGGCAAAUAAGAAUUUGAUAA | 2536 | | RSV: 66L21 ANTISENSE siNA (48C) | AUCAAAUUCUUAUUUGCCCTT | 2648 |
| 5090 | UUCUCCAAAAAACUAAGUGAUUC | 2537 | | RSV: 457L21 ANTISENSE siNA (439C) | AUCACUUAGUUUUUUGGAGTT | 2649 |
| 7837 | CUGGUCAACUAUGAAAUGAAACU | 2538 | | RSV: 833L21 ANTISENSE siNA (815C) | UUUCAUUUCAUAGUUGACCTT | 2650 |
| 1468 | GGGAAGCACUAAAUACAAAAAAU | 2539 | | RSV: 868L21 ANTISENSE siNA (850C) | UUUUUGUAUUUAGUGCUUCTT | 2651 |
| 6758 | CACUCCCAUAAUAUACAAGUAUG | 2540 | | RSV: 988L21 ANTISENSE siNA (970C) | UACUUGUAUAUUAUGGGAGTT | 2652 |
| 3973 | GUCAUCCAGCAAAUACACCAUCC | 2541 | | RSV: 1215L21 ANTISENSE siNA (1197C) | AUGGUGUAUUUGCUGGAUGTT | 2653 |
| 3615 | AACAGCUUCUAUGAAGUGUUUGA | 2542 | | RSV: 1780L21 ANTISENSE siNA (1762C) | AAACACUUCAUAGAAGCUGTT | 2654 |
| 9524 | AACUUGCGUAAACCAAAAAAAUG | 2535 | | RSV: 27U21 SENSE siNA stab04 | B cuuGcGuAAAccAAAAAAATT B | 2655 |
| 1467 | UGGGGCAAAUAAGAAUUUGAUAA | 2536 | | RSV: 48U21 SENSE siNA stab04 | B GGGcAAAuAAGAAuuuGAuTT B | 2656 |
| 5090 | UUCUCCAAAAAACUAAGUGAUUC | 2537 | | RSV: 439U21 SENSE siNA stab04 | B cuccAAAAAAcuAAGuGAuTT B | 2657 |
| 7837 | CUGGUCAACUAUGAAAUGAAACU | 2538 | | RSV: 815U21 SENSE siNA stab04 | B GGucAAcuAuGAAAuGAAATT B | 2658 |
| 1468 | GGGAAGCACUAAAUACAAAAAAU | 2539 | | RSV: 850U21 SENSE siNA stab04 | B GAAGcAcuAAAuAcAAAAATT B | 2659 |
| 6758 | CACUCCCAUAAUAUACAAGUAUG | 2540 | | RSV: 970U21 SENSE siNA stab04 | B cucccAuAAuAuAcAAGuATT B | 2660 |
| 3973 | GUCAUCCAGCAAAUACACCAUCC | 2541 | | RSV: 1197U21 SENSE siNA stab04 | B cAuccAGcAAAuAcAccAuTT B | 2661 |
| 3615 | AACAGCUUCUAUGAAGUGUUUGA | 2542 | | RSV: 1762U21 SENSE siNA stab04 | B cAGcuucuAuGAAGuGuuuTT B | 2662 |
| 9524 | AACUUGCGUAAACCAAAAAAAUG | 2535 | | RSV: 45L21 ANTISENSE siNA (27C) stab05 | uuuuuuuGGuuuAcGcAAGTsT | 2663 |
| 1467 | UGGGGCAAAUAAGAAUUUGAUAA | 2536 | | RSV: 66L21 ANTISENSE siNA (48C) stab05 | AucAAAuucuuAuuuGcccTsT | 2664 |
| 5090 | UUCUCCAAAAAACUAAGUGAUUC | 2537 | | RSV: 457L21 ANTISENSE siNA (439C) stab05 | AucAcuuAGuuuuuuGGAGTsT | 2665 |
| 7837 | CUGGUCAACUAUGAAAUGAAACU | 2538 | | RSV: 833L21 ANTISENSE siNA (815C) stab05 | uuucAuuucAuAGuuGAccTsT | 2666 |
| 1468 | GGGAAGCACUAAAUACAAAAAAU | 2539 | | RSV: 868L21 ANTISENSE siNA (850C) stab05 | uuuuuGuAuuuAGuGcuucTsT | 2667 |
| 6758 | CACUCCCAUAAUAUACAAGUAUG | 2540 | | RSV: 988L21 ANTISENSE siNA (970C) stab05 | uAcuuGuAuAuuAuGGGAGTsT | 2668 |

TABLE III-continued

RSV Synthetic Modified siNA Constructs

| Target Pos | Target | Seq ID | Cmpd# | Aliases | Sequence | Seq ID |
|---|---|---|---|---|---|---|
| 3973 | GUCAUCCAGCAAAUACACCAUCC | 2541 | | RSV: 1215L21 ANTISENSE siNA (1197C) stab05 | AuGGuGuAuuuGcuGGAuGTsT | 2669 |
| 3615 | AACAGCUUCUAUGAAGUGUUUGA | 2542 | | RSV: 1780L21 ANTISENSE siNA (1762C) stab05 | AAAcAcuucAuAGAAGcuGTsT | 2670 |
| 9524 | AACUUGCGUAAACCAAAAAAAUG | 2535 | | RSV: 27U21 SENSE siNA stab07 | B cuuGcGuAAAccAAAAAAATT B | 2671 |
| 1467 | UGGGGCAAAUAAGAAUUUGAUAA | 2536 | | RSV: 48U21 SENSE siNA stab07 | B GGGcAAAuAAGAAuuuGAuTT B | 2672 |
| 5090 | UUCUCCAAAAAACUAAGUGAUUC | 2537 | | RSV: 439U21 SENSE siNA stab07 | B cuccAAAAAAcuAAGuGAuTT B | 2673 |
| 7837 | CUGGUCAACUAUGAAAUGAAACU | 2538 | | RSV: 815U21 SENSE siNA stab07 | B GGucAAcuAuGAAAuGAAATT B | 2674 |
| 1468 | GGGAAGCACUAAAUACAAAAAAU | 2539 | | RSV: 850U21 SENSE siNA stab07 | B GAAGcAcuAAAuAcAAAAATT B | 2675 |
| 6758 | CACUCCCAUAAUAUACAAGUAUG | 2540 | | RSV: 970U21 SENSE siNA stab07 | B cucccAuAAuAuAcAAGuATT B | 2676 |
| 3973 | GUCAUCCAGCAAAUACACCAUCC | 2541 | | RSV: 1197U21 SENSE siNA stab07 | B cAuccAGcAAAuAcAccAuTT B | 2677 |
| 3615 | AACAGCUUCUAUGAAGUGUUUGA | 2542 | | RSV: 1762U21 SENSE siNA stab07 | B cAGcuucuAuGAAGuGuuuTT B | 2678 |
| 9524 | AACUUGCGUAAACCAAAAAAAUG | 2535 | | RSV: 45L21 ANTISENSE siNA (27C) stab11 | uuuuuuuGGuuuAcGcAAGTsT | 2679 |
| 1467 | UGGGGCAAAUAAGAAUUUGAUAA | 2536 | | RSV: 66L21 ANTISENSE siNA (48C) stab11 | AucAAAuucuuAuuuGcccTsT | 2680 |
| 5090 | UUCUCCAAAAAACUAAGUGAUUC | 2537 | | RSV: 457L21 ANTISENSE siNA (439C) stab11 | AucAcuuAGuuuuuuGGAGTsT | 2681 |
| 7837 | CUGGUCAACUAUGAAAUGAAACU | 2538 | | RSV: 833L21 ANTISENSE siNA (815C) stab11 | uuucAuuucAuAGuuGAccTsT | 2682 |
| 1468 | GGGAAGCACUAAAUACAAAAAAU | 2539 | | RSV: 868L21 ANTISENSE siNA (850C) stab11 | uuuuuGuAuuuAGuGcuucTsT | 2683 |
| 6758 | CACUCCCAUAAUAUACAAGUAUG | 2540 | | RSV: 988L21 ANTISENSE siNA (970C) stab11 | uAcuuGuAuAuuAuGGGAGTsT | 2684 |
| 3973 | GUCAUCCAGCAAAUACACCAUCC | 2541 | | RSV: 1215L21 ANTISENSE siNA (1197C) stab11 | AuGGuGuAuuuGcuGGAuGTsT | 2685 |
| 3615 | AACAGCUUCUAUGAAGUGUUUGA | 2542 | | RSV: 1780L21 ANTISENSE siNA (1762C) stab11 | AAAcAcuucAuAGAAGcuGTsT | 2686 |
| 9524 | AACUUGCGUAAACCAAAAAAAUG | 2535 | | RSV: 27U21 SENSE siNA stab18 | B cuuGcGuAAAccAAAAAAATT B | 2687 |
| 1467 | UGGGGCAAAUAAGAAUUUGAUAA | 2536 | | RSV: 48U21 SENSE siNA stab18 | B GGGcAAAuAAGAAuuuGAuTT B | 2688 |
| 5090 | UUCUCCAAAAAACUAAGUGAUUC | 2537 | | RSV: 439U21 SENSE siNA stab18 | B cuccAAAAAAcuAAGuGAuTT B | 2689 |
| 7837 | CUGGUCAACUAUGAAAUGAAACU | 2538 | | RSV: 815U21 SENSE siNA stab18 | B GGucAAcuAuGAAAuGAAATT B | 2690 |
| 1468 | GGGAAGCACUAAAUACAAAAAAU | 2539 | | RSV: 850U21 SENSE siNA stab18 | B GAAGcAcuAAAuAcAAAAATT B | 2691 |
| 6758 | CACUCCCAUAAUAUACAAGUAUG | 2540 | | RSV: 970U21 SENSE siNA stab18 | B cucccAuAAuAuAcAAGuATT B | 2692 |
| 3973 | GUCAUCCAGCAAAUACACCAUCC | 2541 | | RSV: 1197U21 SENSE siNA stab18 | B cAuccAGcAAAuAcAccAuTT B | 2693 |
| 3615 | AACAGCUUCUAUGAAGUGUUUGA | 2542 | | RSV: 1762U21 SENSE siNA stab18 | B cAGcuucuAuGAAGuGuuuTT B | 2694 |
| 9524 | AACUUGCGUAAACCAAAAAAAUG | 2535 | | RSV: 45L21 ANTISENSE siNA (27C) stab08 | uuuuuuuGGuuuAcGcAAGTsT | 2695 |
| 1467 | UGGGGCAAAUAAGAAUUUGAUAA | 2536 | | RSV: 66L21 ANTISENSE siNA (48C) stab08 | AucAAAuucuuAuuuGcccTsT | 2696 |
| 5090 | UUCUCCAAAAAACUAAGUGAUUC | 2537 | | RSV: 457L21 ANTISENSE siNA (439C) stab08 | AucAcuuAGuuuuuuGGAGTsT | 2697 |

TABLE III-continued

RSV Synthetic Modified siNA Constructs

| Target Pos | Target | Seq ID | Cmpd# | Aliases | Sequence | Seq ID |
|---|---|---|---|---|---|---|
| 7837 | CUGGUCAACUAUGAAAUGAAACU | 2538 | | RSV: 833L21 ANTISENSE siNA (815C) stab08 | uuucAuuucAuAGuuGAccTsT | 2698 |
| 1468 | GGGAAGCACUAAAUACAAAAAAU | 2539 | | RSV: 868L21 ANTISENSE siNA (850C) stab08 | uuuuuGuAuuuAGuGcuucTsT | 2699 |
| 6758 | CACUCCCAUAAUAUACAAGUAUG | 2540 | | RSV: 988L21 ANTISENSE siNA (970C) stab08 | uAcuuGuAuAuuAuGGGAGTsT | 2700 |
| 3973 | GUCAUCCAGCAAAUACACCAUCC | 2541 | | RSV: 1215L21 ANTISENSE siNA (1197C) stab08 | AuGGuGuAuuuGcuGGAuGTsT | 2701 |
| 3615 | AACAGCUUCUAUGAAGUGUUUGA | 2542 | | RSV: 1780L21 ANTISENSE siNA (1762C) stab08 | AAAcAcuucAuAGAAGcuGTsT | 2702 |
| 9524 | AACUUGCGUAAACCAAAAAAAUG | 2535 | | RSV: 27U21 SENSE siNA stab09 | B CUUGCGUAAACCAAAAAAATT B | 2703 |
| 1467 | UGGGGCAAAUAAGAAUUUGAUAA | 2536 | | RSV: 48U21 SENSE siNA stab09 | B GGGCAAAUAAGAAUUUGAUTT B | 2704 |
| 5090 | UUCUCCAAAAACUAAGUGAUUC | 2537 | | RSV: 439U21 SENSE siNA stab09 | B CUCCAAAAACUAAGUGAUTT B | 2705 |
| 7837 | CUGGUCAACUAUGAAAUGAAACU | 2538 | | RSV: 815U21 SENSE siNA stab09 | B GGUCAACUAUGAAAUGAAATT B | 2706 |
| 1468 | GGGAAGCACUAAAUACAAAAAAU | 2539 | | RSV: 850U21 SENSE siNA stab09 | B GAAGCACUAAAUACAAAAATT B | 2707 |
| 6758 | CACUCCCAUAAUAUACAAGUAUG | 2540 | | RSV: 970U21 SENSE siNA stab09 | B CUCCCAUAAUAUACAAGUATT B | 2708 |
| 3973 | GUCAUCCAGCAAAUACACCAUCC | 2541 | | RSV: 1197U21 SENSE siNA stab09 | B CAUCCAGCAAAUACACCAUTT B | 2709 |
| 3615 | AACAGCUUCUAUGAAGUGUUUGA | 2542 | | RSV: 1762U21 SENSE siNA stab09 | B CAGCUUCUAUGAAGUGUUUTT B | 2710 |
| 9524 | AACUUGCGUAAACCAAAAAAAUG | 2535 | | RSV: 45L21 ANTISENSE siNA (27C) stab10 | UUUUUUUGGUUUACGCAAGTsT | 2711 |
| 1467 | UGGGGCAAAUAAGAAUUUGAUAA | 2536 | | RSV: 66L21 ANTISENSE siNA (48C) stab10 | AUCAAAUUCUUAUUUGCCCTsT | 2712 |
| 5090 | UUCUCCAAAAACUAAGUGAUUC | 2537 | | RSV: 457L21 ANTISENSE siNA (439C) stab10 | AUCACUUAGUUUUUGGAGTsT | 2713 |
| 7837 | CUGGUCAACUAUGAAAUGAAACU | 2538 | | RSV: 833L21 ANTISENSE siNA (815C) stab10 | UUUCAUUUCAUAGUUGACCTsT | 2714 |
| 1468 | GGGAAGCACUAAAUACAAAAAAU | 2539 | | RSV: 868L21 ANTISENSE siNA (850C) stab10 | UUUUUGUAUUUAGUGCUUCTsT | 2715 |
| 6758 | CACUCCCAUAAUAUACAAGUAUG | 2540 | | RSV: 988L21 ANTISENSE siNA (970C) stab10 | UACUUGUAUAUUAUGGGAGTsT | 2716 |
| 3973 | GUCAUCCAGCAAAUACACCAUCC | 2541 | | RSV: 1215L21 ANTISENSE siNA (1197C) stab10 | AUGGUGUAUUUGCUGGAUGTsT | 2717 |
| 3615 | AACAGCUUCUAUGAAGUGUUUGA | 2542 | | RSV: 1780L21 ANTISENSE siNA (1762C) stab10 | AAACACUUCAUAGAAGCUGTsT | 2718 |
| 9524 | AACUUGCGUAAACCAAAAAAAUG | 2535 | | RSV: 45L21 ANTISENSE siNA (27C) stab19 | uuuuuuuGGuuuAcGcAAGTT B | 2719 |
| 1467 | UGGGGCAAAUAAGAAUUUGAUAA | 2536 | | RSV: 66L21 ANTISENSE siNA (48C) stab19 | AucAAAuucuuAuuuGcccTT B | 2720 |
| 5090 | UUCUCCAAAAACUAAGUGAUUC | 2537 | | RSV: 457L21 ANTISENSE siNA (439C) stab19 | AucAcuuAGuuuuuGGAGTT B | 2721 |
| 7837 | CUGGUCAACUAUGAAAUGAAACU | 2538 | | RSV: 833L21 ANTISENSE siNA (815C) stab19 | uuucAuuucAuAGuuGAccTT B | 2722 |
| 1468 | GGGAAGCACUAAAUACAAAAAAU | 2539 | | RSV: 868L21 ANTISENSE siNA (850C) stab19 | uuuuuGuAuuuAGuGcuucTT B | 2723 |
| 6758 | CACUCCCAUAAUAUACAAGUAUG | 2540 | | RSV: 988L21 ANTISENSE siNA (970C) stab19 | uAcuuGuAuAuuAuGGGAGTT B | 2724 |

TABLE III-continued

RSV Synthetic Modified siNA Constructs

| Target Pos | Target | Seq ID | Cmpd# | Aliases | Sequence | Seq ID |
|---|---|---|---|---|---|---|
| 3973 | GUCAUCCAGCAAAUACACCAUCC | 2541 | | RSV: 1215L21 ANTISENSE siNA (1197C) stab19 | A<u>u</u>GG<u>u</u>G<u>u</u>A<u>uuu</u>G<u>c</u>uGGA<u>u</u>GTT B | 2725 |
| 3615 | AACAGCUUCUAUGAAGUGUUUGA | 2542 | | RSV: 1780L21 ANTISENSE siNA (1762C) stab19 | AAA<u>c</u>A<u>c</u>uu<u>c</u>A<u>u</u>AGAAG<u>c</u>uGTT B | 2726 |
| 9524 | AACUUGCGUAAACCAAAAAAUG | 2535 | | RSV: 45L21 ANTISENSE siNA (27C) stab22 | UUUUUUUGGUUUACGCAAGTT B | 2727 |
| 1467 | UGGGGCAAAUAAGAAUUUGAUAA | 2536 | | RSV: 66L21 ANTISENSE siNA (48C) stab22 | AUCAAAUUCUUAUUUGCCCTT B | 2728 |
| 5090 | UUCUCCAAAAAACUAAGUGAUUC | 2537 | | RSV: 457L21 ANTISENSE siNA (439C) stab22 | AUCACUUAGUUUUUUGGAGTT B | 2729 |
| 7837 | CUGGUCAACUAUGAAAUGAAACU | 2538 | | RSV: 833L21 ANTISENSE siNA (815C) stab22 | UUUCAUUUCAUAGUUGACCTT B | 2730 |
| 1468 | GGGAAGCACUAAAUACAAAAAAU | 2539 | | RSV: 868L21 ANTISENSE siNA (850C) stab22 | UUUUUGUAUUUAGUGCUUCTT B | 2731 |
| 6758 | CACUCCCAUAAUAUACAAGUAUG | 2540 | | RSV: 988L21 ANTISENSE siNA (970C) stab22 | UACUUGUAUAUUAUGGGAGTT B | 2732 |
| 3973 | GUCAUCCAGCAAAUACACCAUCC | 2541 | | RSV: 1215L21 ANTISENSE siNA (1197C) stab22 | AUGGUGUAUUUGCUGGAUGTT B | 2733 |
| 3615 | AACAGCUUCUAUGAAGUGUUUGA | 2542 | | RSV: 1780L21 ANTISENSE siNA (1762C) stab22 | AAACACUUCAUAGAAGCUGTT B | 2734 |
| 9524 | AACUUGCGUAAACCAAAAAAUG | 2535 | | RSV: 45L21 ANTISENSE siNA (27C) stab25 | UU<u>u</u><u>uuuu</u>GG<u>u</u>uuA<u>c</u>G<u>c</u>AAGTsT | 2735 |
| 1467 | UGGGGCAAAUAAGAAUUUGAUAA | 2536 | | RSV: 66L21 ANTISENSE siNA (48C) stab25 | AU<u>c</u>AAA<u>u</u>u<u>c</u>uuA<u>u</u>uuG<u>c</u><u>cc</u>TsT | 2736 |
| 5090 | UUCUCCAAAAAACUAAGUGAUUC | 2537 | | RSV: 457L21 ANTISENSE siNA (439C) stab25 | AU<u>c</u>A<u>c</u>uuAG<u>uuuuuu</u>GGAGTsT | 2737 |
| 7837 | CUGGUCAACUAUGAAAUGAAACU | 2538 | | RSV: 833L21 ANTISENSE siNA (815C) stab25 | UU<u>u</u><u>c</u>A<u>u</u>uu<u>c</u>A<u>u</u>AG<u>u</u>uGA<u>cc</u>TsT | 2738 |
| 1468 | GGGAAGCACUAAAUACAAAAAAU | 2539 | | RSV: 868L21 ANTISENSE siNA (850C) stab25 | UU<u>u</u>uuGuA<u>u</u>uuAG<u>u</u>G<u>c</u>uu<u>c</u>TsT | 2739 |
| 6758 | CACUCCCAUAAUAUACAAGUAUG | 2540 | | RSV: 988L21 ANTISENSE siNA (970C) stab25 | UA<u>C</u>uu<u>G</u>uA<u>u</u>A<u>u</u>uA<u>u</u>GGGAGTsT | 2740 |
| 3973 | GUCAUCCAGCAAAUACACCAUCC | 2541 | | RSV: 1215L21 ANTISENSE siNA (1197C) stab25 | AUGG<u>u</u>G<u>u</u>A<u>u</u>uuG<u>c</u>uGGA<u>u</u>GTsT | 2741 |
| 3615 | AACAGCUUCUAUGAAGUGUUUGA | 2542 | | RSV: 1780L21 ANTISENSE siNA (1762C) stab25 | AAA<u>c</u>A<u>c</u>uu<u>c</u>A<u>u</u>AGAAG<u>c</u>uGTsT | 2742 |

Uppercase = ribonucleotide
u,c = 2'-deoxy-2'-fluoro U,C
T = thymidine
B = inverted deoxy abasic
s = phosphorothioate linkage
A = deoxy Adenosine
G = deoxy Guanosine
<u>G</u> = 2'-O-methyl Guanosine
<u>A</u> = 2'-O-methyl Adenosine

TABLE IV

Non-limiting examples of Stabilization Chemistries for chemically modified siNA constructs

| Chemistry | pyrimidine | Purine | cap | p = S | Strand |
|---|---|---|---|---|---|
| "Stab 00" | Ribo | Ribo | TT at 3'-ends | | S/AS |
| "Stab 1" | Ribo | Ribo | — | 5 at 5'-end 1 at 3'-end | S/AS |
| "Stab 2" | Ribo | Ribo | — | All linkages | Usually AS |
| "Stab 3" | 2'-fluoro | Ribo | — | 4 at 5'-end 4 at 3'-end | Usually S |
| "Stab 4" | 2'-fluoro | Ribo | 5' and 3'-ends | — | Usually S |
| "Stab 5" | 2'-fluoro | Ribo | — | 1 at 3'-end | Usually AS |
| "Stab 6" | 2'-O-Methyl | Ribo | 5' and 3'-ends | — | Usually S |
| "Stab 7" | 2'-fluoro | 2'-deoxy | 5' and 3'-ends | — | Usually S |
| "Stab 8" | 2'-fluoro | 2'-O-Methyl | — | 1 at 3'-end | S/AS |
| "Stab 9" | Ribo | Ribo | 5' and 3'-ends | — | Usually S |
| "Stab 10" | Ribo | Ribo | — | 1 at 3'-end | Usually AS |
| "Stab 11" | 2'-fluoro | 2'-deoxy | — | 1 at 3'-end | Usually AS |
| "Stab 12" | 2'-fluoro | LNA | 5' and 3'-ends | | Usually S |
| "Stab 13" | 2'-fluoro | LNA | | 1 at 3'-end | Usually AS |
| "Stab 14" | 2'-fluoro | 2'-deoxy | | 2 at 5'-end 1 at 3'-end | Usually AS |
| "Stab 15" | 2'-deoxy | 2'-deoxy | | 2 at 5'-end 1 at 3'-end | Usually AS |
| "Stab 16" | Ribo | 2'-O-Methyl | 5' and 3'-ends | | Usually S |
| "Stab 17" | 2'-O-Methyl | 2'-O-Methyl | 5' and 3'-ends | | Usually S |
| "Stab 18" | 2'-fluoro | 2'-O-Methyl | 5' and 3'-ends | | Usually S |
| "Stab 19" | 2'-fluoro | 2'-O-Methyl | 3'-end | | S/AS |
| "Stab 20" | 2'-fluoro | 2'-deoxy | 3'-end | | Usually AS |
| "Stab 21" | 2'-fluoro | Ribo | 3'-end | | Usually AS |
| "Stab 22" | Ribo | Ribo | 3'-end | | Usually AS |
| "Stab 23" | 2'-fluoro* | 2'-deoxy* | 5' and 3'-ends | | Usually S |
| "Stab 24" | 2'-fluoro* | 2'-O-Methyl* | — | 1 at 3'-end | S/AS |
| "Stab 25" | 2'-fluoro* | 2'-O-Methyl* | — | 1 at 3'-end | S/AS |
| "Stab 26" | 2'-fluoro* | 2'-O-Methyl* | — | | S/AS |
| "Stab 27" | 2'-fluoro* | 2'-O-Methyl* | 3'-end | | S/AS |
| "Stab 28" | 2'-fluoro* | 2'-O-Methyl* | 3'-end | | S/AS |
| "Stab 29" | 2'-fluoro* | 2'-O-Methyl* | | 1 at 3'-end | S/AS |
| "Stab 30" | 2'-fluoro* | 2'-O-Methyl* | | | S/AS |
| "Stab 31" | 2'-fluoro* | 2'-O-Methyl* | 3'-end | | S/AS |
| "Stab 32" | 2'-fluoro | 2'-O-Methyl | | | S/AS |
| "Stab 33" | 2'-fluoro | 2'-deoxy* | 5' and 3'-ends | | Usually S |
| "Stab 34" | 2'-fluoro | 2'-O-Methyl* | 5' and 3'-ends | | Usually S |
| "Stab 35" | 2'-fluoro | 2'-O-Methyl** | | | Usually AS |
| "Stab 36" | 2'-fluoro | 2'-O-Methyl** | | | Usually AS |
| "Stab 3F" | 2'-OCF3 | Ribo | — | 4 at 5'-end 4 at 3'-end | Usually S |
| "Stab 4F" | 2'-OCF3 | Ribo | 5' and 3'-ends | — | Usually S |
| "Stab 5F" | 2'-OCF3 | Ribo | — | 1 at 3'-end | Usually AS |
| "Stab 7F" | 2'-OCF3 | 2'-deoxy | 5' and 3'-ends | — | Usually S |
| "Stab 8F" | 2'-OCF3 | 2'-O-Methyl | — | 1 at 3'-end | S/AS |
| "Stab 11F" | 2'-OCF3 | 2'-deoxy | — | 1 at 3'-end | Usually AS |

TABLE IV-continued

Non-limiting examples of Stabilization Chemistries for chemically modified siNA constructs

| Chemistry | pyrimidine | Purine | cap | p = S | Strand |
|---|---|---|---|---|---|
| "Stab 12F" | 2'-OCF3 | LNA | 5' and 3'-ends | | Usually S |
| "Stab 13F" | 2'-OCF3 | LNA | | 1 at 3'-end | Usually AS |
| "Stab 14F" | 2'-OCF3 | 2'-deoxy | | 2 at 5'-end 1 at 3'-end | Usually AS |
| "Stab 15F" | 2'-OCF3 | 2'-deoxy | | 2 at 5'-end 1 at 3'-end | Usually AS |
| "Stab 18F" | 2'-OCF3 | 2'-O-Methyl | 5' and 3'-ends | | Usually S |
| "Stab 19F" | 2'-OCF3 | 2'-O-Methyl | 3'-end | | S/AS |
| "Stab 20F" | 2'-OCF3 | 2'-deoxy | 3'-end | | Usually AS |
| "Stab 21F" | 2'-OCF3 | Ribo | 3'-end | | Usually AS |
| "Stab 23F" | 2'-OCF3* | 2'-deoxy* | 5' and 3'-ends | | Usually S |
| "Stab 24F" | 2'-OCF3* | 2'-O-Methyl* | — | 1 at 3'-end | S/AS |
| "Stab 25F" | 2'-OCF3* | 2'-O-Methyl* | — | 1 at 3'-end | S/AS |
| "Stab 26F" | 2'-OCF3* | 2'-O-Methyl* | — | | S/AS |
| "Stab 27F" | 2'-OCF3* | 2'-O-Methyl* | 3'-end | | S/AS |
| "Stab 28F" | 2'-OCF3* | 2'-O-Methyl* | 3'-end | | S/AS |
| "Stab 29F" | 2'-OCF3* | 2'-O-Methyl* | | 1 at 3'-end | S/AS |
| "Stab 30F" | 2'-OCF3* | 2'-O-Methyl* | | | S/AS |
| "Stab 31F" | 2'-OCF3* | 2'-O-Methyl* | 3'-end | | S/AS |
| "Stab 32F" | 2'-OCF3 | 2'-O-Methyl | | | S/AS |
| "Stab 33F" | 2'-OCF3 | 2'-deoxy* | 5' and 3'-ends | — | Usually S |
| "Stab 34F" | 2'-OCF3 | 2'-O-Methyl* | 5' and 3'-ends | | Usually S |
| "Stab 35" | 2'-OCF3 | 2'-O-Methyl** | | | Usually AS |
| "Stab 36" | 2'-OCF3 | 2'-O-Methyl** | | | Usually AS |

CAP = any terminal cap, see for example FIG. 10.
All Stab 00-36 chemistries can comprise 3'-terminal thymidine (TT) residues
All Stab 00-36 chemistries typically comprise about 21 nucleotides, but can vary as described herein.
All Stab 00-36 chemistries can also include a single ribonucleotide in the sense or passenger strand at the 11$^{th}$ base paired position of the double stranded nucleic acid duplex as determined from the 5'-end of the antisense or guide strand (see FIG. 6C)
S = sense strand
AS = antisense strand
*Stab 23 has a single ribonucleotide adjacent to 3'-CAP
*Stab 24 and Stab 28 have a single ribonucleotide at 5'-terminus
*Stab 25, Stab 26, and Stab 27 have three ribonucleotides at 5'-terminus
*Stab 29, Stab 30, Stab 31, Stab 33, and Stab 34 any purine at first three nucleotide positions from 5'-terminus are ribonucleotides
p = phosphorothioate linkage
**Stab 35 has 2'-O-methyl U at 3'-overhangs
**Stab 36 has 2'-O-methyl overhangs that are complementary to the target sequence (naturually occurring overhangs)

TABLE V

| Reagent | Equivalents | Amount | Wait Time* DNA | Wait Time* 2'-O-methyl | Wait Time* RNA |
|---|---|---|---|---|---|
| A. 2.5 µmol Synthesis Cycle ABI 394 Instrument | | | | | |
| Phosphoramidites | 6.5 | 163 µL | 45 sec | 2.5 min | 7.5 min |
| S-Ethyl Tetrazole | 23.8 | 238 µL | 45 sec | 2.5 min | 7.5 min |
| Acetic Anhydride | 100 | 233 µL | 5 sec | 5 sec | 5 sec |
| N-Methyl Imidazole | 186 | 233 µL | 5 sec | 5 sec | 5 sec |
| TCA | 176 | 2.3 mL | 21 sec | 21 sec | 21 sec |
| Iodine | 11.2 | 1.7 mL | 45 sec | 45 sec | 45 sec |
| Beaucage | 12.9 | 645 µL | 100 sec | 300 sec | 300 sec |
| Acetonitrile | NA | 6.67 mL | NA | NA | NA |

TABLE V-continued

B. 0.2 μmol Synthesis Cycle ABI 394 Instrument

| Phosphoramidites | 15 | 31 μL | 45 sec | 233 sec | 465 sec |
| --- | --- | --- | --- | --- | --- |
| S-Ethyl Tetrazole | 38.7 | 31 μL | 45 sec | 233 min | 465 sec |
| Acetic Anhydride | 655 | 124 μL | 5 sec | 5 sec | 5 sec |
| N-Methyl Imidazole | 1245 | 124 μL | 5 sec | 5 sec | 5 sec |
| TCA | 700 | 732 μL | 10 sec | 10 sec | 10 sec |
| Iodine | 20.6 | 244 μL | 15 sec | 15 sec | 15 sec |
| Beaucage | 7.7 | 232 μL | 100 sec | 300 sec | 300 sec |
| Acetonitrile | NA | 2.64 mL | NA | NA | NA |

C. 0.2 μmol Synthesis Cycle 96 well Instrument

| Reagent | Equivalents: DNA/2'-O-methyl/Ribo | Amount: DNA/2'-O-methyl/Ribo | Wait Time* DNA | Wait Time* 2'-O-methyl | Wait Time* Ribo |
| --- | --- | --- | --- | --- | --- |
| Phosphoramidites | 22/33/66 | 40/60/120 μL | 60 sec | 180 sec | 360 sec |
| S-Ethyl Tetrazole | 70/105/210 | 40/60/120 μL | 60 sec | 180 min | 360 sec |
| Acetic Anhydride | 265/265/265 | 50/50/50 μL | 10 sec | 10 sec | 10 sec |
| N-Methyl Imidazole | 502/502/502 | 50/50/50 μL | 10 sec | 10 sec | 10 sec |
| TCA | 238/475/475 | 250/500/500 μL | 15 sec | 15 sec | 15 sec |
| Iodine | 6.8/6.8/6.8 | 80/80/80 μL | 30 sec | 30 sec | 30 sec |
| Beaucage | 34/51/51 | 80/120/120 μL | 100 sec | 200 sec | 200 sec |
| Acetonitrile | NA | 1150/1150/1150 μL | NA | NA | NA |

Wait time does not include contact time during delivery.
Tandem synthesis utilizes double coupling of linker molecule

TABLE VI

Lipid Nanoparticle (LNP) Formulations

| Formulation # | Composition | Molar Ratio |
| --- | --- | --- |
| L051 | CLinDMA/DSPC/Chol/PEG-n-DMG | 48/40/10/2 |
| L053 | DMOBA/DSPC/Chol/PEG-n-DMG | 30/20/48/2 |
| L054 | DMOBA/DSPC/Chol/PEG-n-DMG | 50/20/28/2 |
| L069 | CLinDMA/DSPC/Cholesterol/PEG-Cholesterol | 48/40/10/2 |
| L073 | pCLinDMA or CLin DMA/DMOBA/DSPC/Chol/PEG-n-DMG | 25/25/20/28/2 |
| L077 | eCLinDMA/DSPC/Cholesterol/2KPEG-Chol | 48/40/10/2 |
| L080 | eCLinDMA/DSPC/Cholesterol/2KPEG-DMG | 48/40/10/2 |
| L082 | pCLinDMA/DSPC/Cholesterol/2KPEG-DMG | 48/40/10/2 |
| L083 | pCLinDMA/DSPC/Cholesterol/2KPEG-Chol | 48/40/10/2 |
| L086 | CLinDMA/DSPC/Cholesterol/2KPEG-DMG/Linoleyl alcohol | 43/38/10/2/7 |
| L061 | DMLBA/Cholesterol/2KPEG-DMG | 52/45/3 |
| L060 | DMOBA/Cholesterol/2KPEG-DMG N/P ratio of 5 | 52/45/3 |
| L097 | DMLBA/DSPC/Cholesterol/2KPEG-DMG | 50/20/28 |
| L098 | DMOBA/Cholesterol/2KPEG-DMG, N/P ratio of 3 | 52/45/3 |
| L099 | DMOBA/Cholesterol/2KPEG-DMG, N/P ratio of 4 | 52/45/3 |
| L100 | DMOBA/DOBA/3% PEG-DMG, N/P ratio of 3 | 52/45/3 |
| L101 | DMOBA/Cholesterol/2KPEG-Cholesterol | 52/45/3 |
| L102 | DMOBA/Cholesterol/2KPEG-Cholesterol, N/P ratio of 5 | 52/45/3 |
| L103 | DMLBA/2KPEG-Cholesterol | 52/45/3 |
| L104 | CLinDMA/DSPC/Cholesterol/2KPEG-cholesterol/Linoleyl alcohol | 43/38/10/2/7 |
| L105 | DMOBA/Cholesterol/2KPEG-Chol, N/P ratio of 2 | 52/45/3 |
| L106 | DMOBA/Cholesterol/2KPEG-Chol, N/P ratio of 3 | 67/30/3 |
| L107 | DMOBA/Cholesterol/2KPEG-Chol, N/P ratio of 1.5 | 52/45/3 |
| L108 | DMOBA/Cholesterol/2KPEG-Chol, N/P ratio of 2 | 67/30/3 |
| L109 | DMOBA/DSPC/Cholesterol/2KPEG-Chol, N/P ratio of 2 | 50/20/28/2 |
| L110 | DMOBA/Cholesterol/2KPEG-DMG, N/P ratio of 1.5 | 52/45/3 |
| L111 | DMOBA/Cholesterol/2KPEG-DMG, N/P ratio of 1.5 | 67/30/3 |
| L112 | DMLBA/Cholesterol/2KPEG-DMG, N/P ratio of 1.5 | 52/45/3 |
| L113 | DMLBA/Cholesterol/2KPEG-DMG, N/P ratio of 1.5 | 67/30/3 |
| L114 | DMOBA/Cholesterol/2KPEG-DMG, N/P ratio of 2 | 52/45/3 |
| L115 | DMOBA/Cholesterol/2KPEG-DMG, N/P ratio of 2 | 67/30/3 |
| L116 | DMLBA/Cholesterol/2KPEG-DMG, N/P ratio of 2 | 52/45/3 |
| L117 | DMLBA/Cholesterol/2KPEG-DMG, N/P ratio of 2 | 52/45/3 |

N/P ratio = Nitrogen:Phosphorous ratio between cationic lipid and nucleic acid

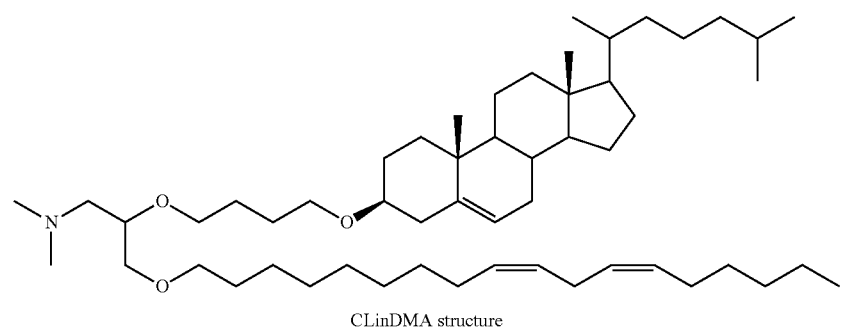
CLinDMA structure
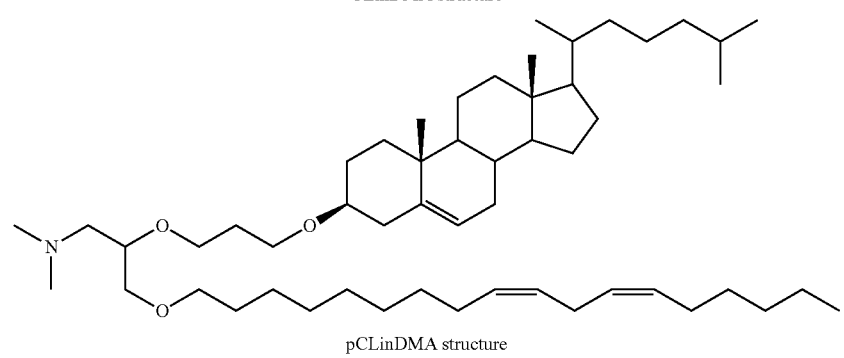
pCLinDMA structure
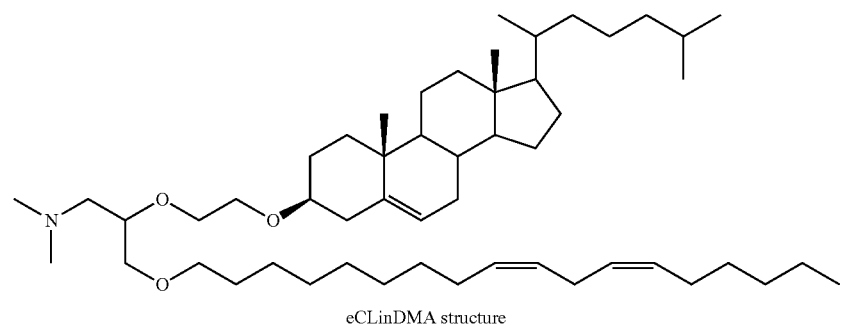
eCLinDMA structure
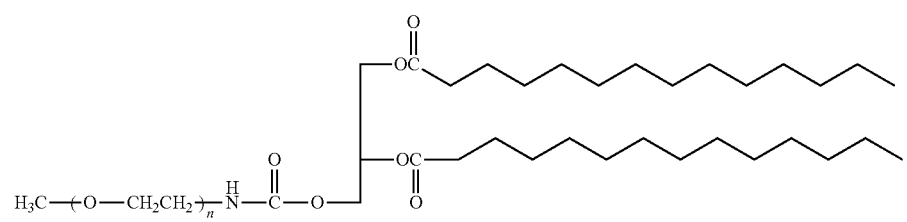
PEG-n-DMG structure
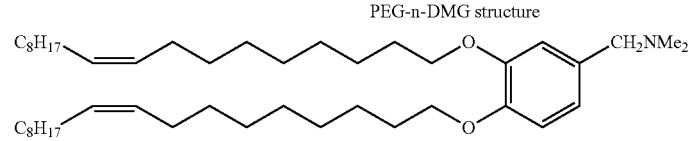
DMOBA structure
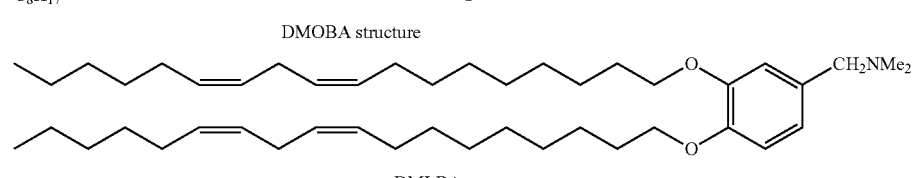
DMLBA structure
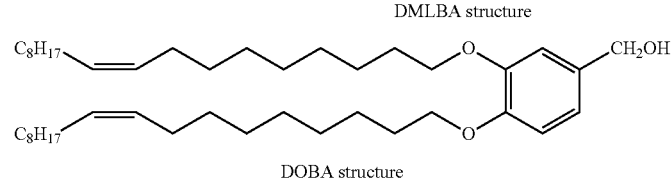
DOBA structure

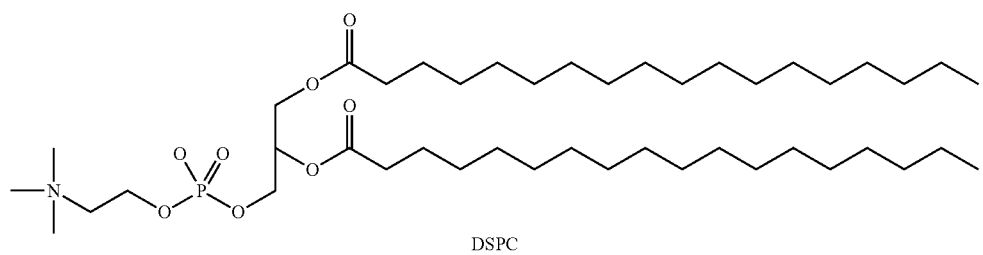

DSPC

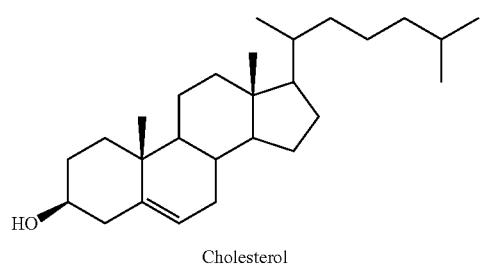

Cholesterol

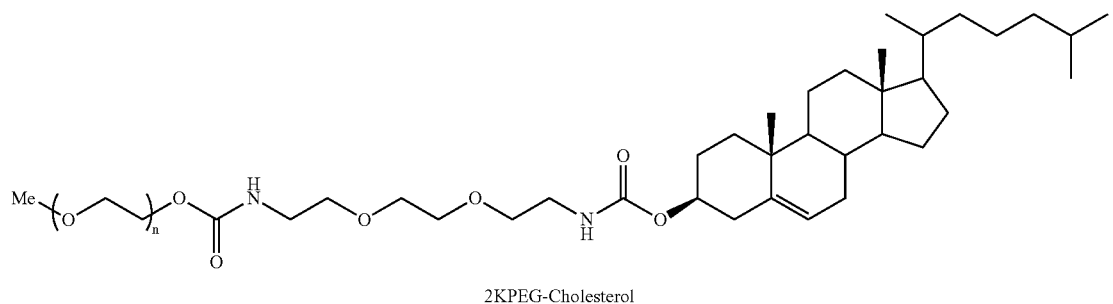

2KPEG-Cholesterol

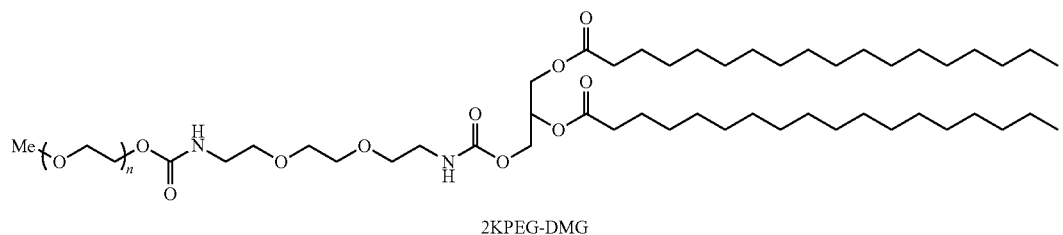

2KPEG-DMG

TABLE VII

Sirna algorithm describing patterns with their relative score for predicting hyperactive siNAs. All the positions given are for the sense strand of 19-mer siNA.

| Description of pattern | Pattern # | Score |
|---|---|---|
| G or C at position 1 | 1 | 5 |
| A or U at position 19 | 2 | 10 |
| A/U rich between position 15-19 | 3 | 10 |
| String of 4 Gs or 4 Cs (not preferred) | 4 | −100 |
| G/C rich between position 1-5 | 5 | 10 |
| A or U at position 18 | 6 | 5 |
| A or U at position 10 | 7 | 10 |
| G at position 13 (not preferred) | 8 | −3 |
| A at position 13 | 9 | 3 |
| G at position 9 (not preferred) | 10 | −3 |
| A at position 9 | 11 | 3 |
| A or U at position 14 | 12 | 10 |

SEQUENCE LISTING (2764 sequences)

SEQ ID NO: 1 - RNA, 19 nt, Artificial Sequence
  Synthetic
aaaaaauggggcaaauaag

SEQ ID NO: 2 - RNA, 19 nt, Artificial Sequence
  Synthetic
aaaaauggggcaaauaaga

SEQ ID NO: 3 - RNA, 19 nt, Artificial Sequence
  Synthetic
aaaauggggcaaauaagaa

SEQ ID NO: 4 - RNA, 19 nt, Artificial Sequence
  Synthetic
aaauggggcaaauaagaau

SEQ ID NO: 5 - RNA, 19 nt, Artificial Sequence
  Synthetic
aauggggcaaauaagaauu

SEQ ID NO: 6 - RNA, 19 nt, Artificial Sequence
  Synthetic
auggggcaaauaagaauuu

SEQ ID NO: 7 - RNA, 19 nt, Artificial Sequence
  Synthetic
uggggcaaauaagaauuug

SEQ ID NO: 8 - RNA, 19 nt, Artificial Sequence
  Synthetic
ggggcaaauaagaauuuga

SEQ ID NO: 9 - RNA, 19 nt, Artificial Sequence
  Synthetic
gggcaaauaagaauuugau

SEQ ID NO: 10 - RNA, 19 nt, Artificial Sequence
  Synthetic
ggcaaauaagaauuugaua

SEQ ID NO: 11 - RNA, 19 nt, Artificial Sequence
  Synthetic
gcaaauaagaauuugauaa

SEQ ID NO: 12 - RNA, 19 nt, Artificial Sequence
  Synthetic
caaauaagaauuugauaag

SEQ ID NO: 13 - RNA, 19 nt, Artificial Sequence
  Synthetic
aaauaagaauuugauaagu

SEQ ID NO: 14 - RNA, 19 nt, Artificial Sequence
  Synthetic
gaaguagcauuguuaaaaa

SEQ ID NO: 15 - RNA, 19 nt, Artificial Sequence
  Synthetic
aaguagcauuguuaaaaau

SEQ ID NO: 16 - RNA, 19 nt, Artificial Sequence
  Synthetic
aguagcauuguuaaaaaua

SEQ ID NO: 17 - RNA, 19 nt, Artificial Sequence
  Synthetic
guagcauuguuaaaaauaa

SEQ ID NO: 18 - RNA, 19 nt, Artificial Sequence
  Synthetic
uagcauuguuaaaaauaac

SEQ ID NO: 19 - RNA, 19 nt, Artificial Sequence
  Synthetic
agcauuguuaaaaauaaca

SEQ ID NO: 20 - RNA, 19 nt, Artificial Sequence
  Synthetic
gcauuguuaaaaauaacau

SEQ ID NO: 21 - RNA, 19 nt, Artificial Sequence
  Synthetic
cauuguuaaaaauaacaug

SEQ ID NO: 22 - RNA, 19 nt, Artificial Sequence
  Synthetic
agaaaacuugaugaaagac

SEQ ID NO: 23 - RNA, 19 nt, Artificial Sequence
  Synthetic
gaaaacuugaugaaagaca

SEQ ID NO: 24 - RNA, 19 nt, Artificial Sequence
  Synthetic
auuggcauuaagccuacaa

SEQ ID NO: 25 - RNA, 19 nt, Artificial Sequence
  Synthetic
uuggcauuaagccuacaaa

SEQ ID NO: 26 - RNA, 19 nt, Artificial Sequence
  Synthetic
auggcucuuagcaaaguca

SEQ ID NO: 27 - RNA, 19 nt, Artificial Sequence
  Synthetic
uggcucuuagcaaagucaa

SEQ ID NO: 28 - RNA, 19 nt, Artificial Sequence
  Synthetic
ggcucuuagcaaagucaag

SEQ ID NO: 29 - RNA, 19 nt, Artificial Sequence
  Synthetic
gcucuuagcaaagucaagu

SEQ ID NO: 30 - RNA, 19 nt, Artificial Sequence
  Synthetic
cucuuagcaaagucaaguu

SEQ ID NO: 31 - RNA, 19 nt, Artificial Sequence
  Synthetic
uuaauagguauguuauaug

SEQ ID NO: 32 - RNA, 19 nt, Artificial Sequence
  Synthetic
uaauagguauguuauaugc

SEQ ID NO: 33 - RNA, 19 nt, Artificial Sequence
  Synthetic
auugagauagaaucuagaa

SEQ ID NO: 34 - RNA, 19 nt, Artificial Sequence
  Synthetic
uugagauagaaucuagaaa

SEQ ID NO: 35 - RNA, 19 nt, Artificial Sequence
  Synthetic
uccuacaaaaaaaugcuaa

SEQ ID NO: 36 - RNA, 19 nt, Artificial Sequence
  Synthetic
ccuacaaaaaaaugcuaaa

SEQ ID NO: 37 - RNA, 19 nt, Artificial Sequence
  Synthetic
cuacaaaaaaaugcuaaaa

SEQ ID NO: 38 - RNA, 19 nt, Artificial Sequence
  Synthetic
uacaaaaaaaugcuaaaag

SEQ ID NO: 39 - RNA, 19 nt, Artificial Sequence
  Synthetic
acaaaaaaaugcuaaaaga

SEQ ID NO: 40 - RNA, 19 nt, Artificial Sequence
  Synthetic
uucuaccauauauugaaca

SEQ ID NO: 41 - RNA, 19 nt, Artificial Sequence
  Synthetic
ucuaccauauauugaacaa

SEQ ID NO: 42 - RNA, 19 nt, Artificial Sequence
  Synthetic
aaauuccuagaaucaauaa

SEQ ID NO: 43 - RNA, 19 nt, Artificial Sequence
  Synthetic
aauuccuagaaucaauaaa

SEQ ID NO: 44 - RNA, 19 nt, Artificial Sequence
  Synthetic
auuccuagaaucaauaaag

SEQ ID NO: 45 - RNA, 19 nt, Artificial Sequence
  Synthetic
uuccuagaaucaauaaagg

SEQ ID NO: 46 - RNA, 19 nt, Artificial Sequence
  Synthetic
uccuagaaucaauaaaggg

SEQ ID NO: 47 - RNA, 19 nt, Artificial Sequence
  Synthetic
ccuagaaucaauaaagggc

SEQ ID NO: 48 - RNA, 19 nt, Artificial Sequence
  Synthetic
cuagaaucaauaaagggca

SEQ ID NO: 49 - RNA, 19 nt, Artificial Sequence
  Synthetic
uagaaucaauaaagggcaa

SEQ ID NO: 50 - RNA, 19 nt, Artificial Sequence
  Synthetic
aacucaauagauauagaag

SEQ ID NO: 51 - RNA, 19 nt, Artificial Sequence
  Synthetic
acucaauagauauagaagu

SEQ ID NO: 52 - RNA, 19 nt, Artificial Sequence
  Synthetic
cucaauagauauagaagua

SEQ ID NO: 53 - RNA, 19 nt, Artificial Sequence
  Synthetic
ucaauagauauagaaguaa

SEQ ID NO: 54 - RNA, 19 nt, Artificial Sequence
  Synthetic
caauagauauagaaguaac

SEQ ID NO: 55 - RNA, 19 nt, Artificial Sequence
  Synthetic
acauuugauaacaaugaag

SEQ ID NO: 56 - RNA, 19 nt, Artificial Sequence
  Synthetic
cauuugauaacaaugaaga

SEQ ID NO: 57 - RNA, 19 nt, Artificial Sequence
  Synthetic
auuugauaacaaugaagaa

SEQ ID NO: 58 - RNA, 19 nt, Artificial Sequence
  Synthetic
uuugauaacaaugaagaag

SEQ ID NO: 59 - RNA, 19 nt, Artificial Sequence
  Synthetic
uugauaacaaugaagaaga

SEQ ID NO: 60 - RNA, 19 nt, Artificial Sequence
  Synthetic
ugauaacaaugaagaagaa

SEQ ID NO: 61 - RNA, 19 nt, Artificial Sequence
  Synthetic
gauaacaaugaagaagaau

SEQ ID NO: 62 - RNA, 19 nt, Artificial Sequence
  Synthetic
auaacaaugaagaagaauc

SEQ ID NO: 63 - RNA, 19 nt, Artificial Sequence
  Synthetic
auugaugaaaaauuaagug

SEQ ID NO: 64 - RNA, 19 nt, Artificial Sequence
  Synthetic
uugaugaaaaauuaaguga

SEQ ID NO: 65 - RNA, 19 nt, Artificial Sequence
  Synthetic
ugaugaaaaauuaagugaa

SEQ ID NO: 66 - RNA, 19 nt, Artificial Sequence
  Synthetic
gaugaaaaauuaagugaaa

SEQ ID NO: 67 - RNA, 19 nt, Artificial Sequence
  Synthetic
augaaaaauuaagugaaau

SEQ ID NO: 68 - RNA, 19 nt, Artificial Sequence
  Synthetic
ugaaaaauuaagugaaaua

SEQ ID NO: 69 - RNA, 19 nt, Artificial Sequence
  Synthetic
gaagcauuaaugaccaaug

SEQ ID NO: 70 - RNA, 19 nt, Artificial Sequence
  Synthetic
aagcauuaaugaccaauga

SEQ ID NO: 71 - RNA, 19 nt, Artificial Sequence
  Synthetic
uggggcaaauauggaaaca

SEQ ID NO: 72 - RNA, 19 nt, Artificial Sequence
  Synthetic
ggggcaaauauggaaacau

SEQ ID NO: 73 - RNA, 19 nt, Artificial Sequence
  Synthetic
gggcaaauauggaaacaua

SEQ ID NO: 74 - RNA, 19 nt, Artificial Sequence
  Synthetic
ggcaaauauggaaacauac

SEQ ID NO: 75 - RNA, 19 nt, Artificial Sequence
  Synthetic
gcaaauauggaaacauacg

SEQ ID NO: 76 - RNA, 19 nt, Artificial Sequence
  Synthetic
caaauauggaaacauacgu

SEQ ID NO: 77 - RNA, 19 nt, Artificial Sequence
  Synthetic
aaauauggaaacauacgug

SEQ ID NO: 78 - RNA, 19 nt, Artificial Sequence
  Synthetic
aauauggaaacauacguga

SEQ ID NO: 79 - RNA, 19 nt, Artificial Sequence
  Synthetic
auauggaaacauacgugaa

SEQ ID NO: 80 - RNA, 19 nt, Artificial Sequence
  Synthetic
uauggaaacauacgugaac

SEQ ID NO: 81 - RNA, 19 nt, Artificial Sequence
  Synthetic
auggaaacauacgugaaca

SEQ ID NO: 82 - RNA, 19 nt, Artificial Sequence
  Synthetic
uggaaacauacgugaacaa

SEQ ID NO: 83 - RNA, 19 nt, Artificial Sequence
  Synthetic
cuucacgaaggcuccacau

SEQ ID NO: 84 - RNA, 19 nt, Artificial Sequence
  Synthetic
uucacgaaggcuccacaua

SEQ ID NO: 85 - RNA, 19 nt, Artificial Sequence
  Synthetic
ucacgaaggcuccacauac

SEQ ID NO: 86 - RNA, 19 nt, Artificial Sequence
  Synthetic
cacgaaggcuccacauaca

SEQ ID NO: 87 - RNA, 19 nt, Artificial Sequence
  Synthetic
acgaaggcuccacauacac

SEQ ID NO: 88 - RNA, 19 nt, Artificial Sequence
  Synthetic
cgaaggcuccacauacaca

SEQ ID NO: 89 - RNA, 19 nt, Artificial Sequence
  Synthetic
gaaggcuccacauacacag

SEQ ID NO: 90 - RNA, 19 nt, Artificial Sequence
  Synthetic
aaggcuccacauacacagc

SEQ ID NO: 91 - RNA, 19 nt, Artificial Sequence
  Synthetic
uuaaccagcaaaguguuag

SEQ ID NO: 92 - RNA, 19 nt, Artificial Sequence
  Synthetic
uaaccagcaaaguguuaga

SEQ ID NO: 93 - RNA, 19 nt, Artificial Sequence
  Synthetic
auaacaaaugaucagaaaa

SEQ ID NO: 94 - RNA, 19 nt, Artificial Sequence
  Synthetic
uaacaaaugaucagaaaaa

SEQ ID NO: 95 - RNA, 19 nt, Artificial Sequence
  Synthetic
aaucgaguauuuugugaca

SEQ ID NO: 96 - RNA, 19 nt, Artificial Sequence
  Synthetic
aucgaguauuuugugacac

SEQ ID NO: 97 - RNA, 19 nt, Artificial Sequence
  Synthetic
uuugaugcaucaauaucuc

SEQ ID NO: 98 - RNA, 19 nt, Artificial Sequence
  Synthetic
uugaugcaucaauaucuca

SEQ ID NO: 99 - RNA, 19 nt, Artificial Sequence
  Synthetic
ugaugcaucaauaucucaa

SEQ ID NO: 100 - RNA, 19 nt, Artificial Sequence
  Synthetic
gaugcaucaauaucucaag

SEQ ID NO: 101 - RNA, 19 nt, Artificial Sequence
  Synthetic
augcaucaauaucucaagu

SEQ ID NO: 102 - RNA, 19 nt, Artificial Sequence
  Synthetic
ugcaucaauaucucaaguc

SEQ ID NO: 103 - RNA, 19 nt, Artificial Sequence
  Synthetic
gcaucaauaucucaaguca

SEQ ID NO: 104 - RNA, 19 nt, Artificial Sequence
  Synthetic
caucaauaucucaagucaa

SEQ ID NO: 105 - RNA, 19 nt, Artificial Sequence
  Synthetic
uaguuggagugcuagagag

SEQ ID NO: 106 - RNA, 19 nt, Artificial Sequence
  Synthetic
aguuggagugcuagagagu

SEQ ID NO: 107 - RNA, 19 nt, Artificial Sequence
  Synthetic
guuggagugcuagagaguu

SEQ ID NO: 108 - RNA, 19 nt, Artificial Sequence
  Synthetic
uuggagugcuagagaguua

SEQ ID NO: 109 - RNA, 19 nt, Artificial Sequence
  Synthetic
aaacaaucagcauguguug

SEQ ID NO: 110 - RNA, 19 nt, Artificial Sequence
  Synthetic
aacaaucagcauguguugc

SEQ ID NO: 111 - RNA, 19 nt, Artificial Sequence
  Synthetic
aagauaagaguguacaaua

SEQ ID NO: 112 - RNA, 19 nt, Artificial Sequence
  Synthetic
agauaagaguguacaauac

SEQ ID NO: 113 - RNA, 19 nt, Artificial Sequence
  Synthetic
gauaagaguguacaauacu

SEQ ID NO: 114 - RNA, 19 nt, Artificial Sequence
  Synthetic
auaagaguguacaauacug

SEQ ID NO: 115 - RNA, 19 nt, Artificial Sequence
  Synthetic
uaagaguguacaauacugu

SEQ ID NO: 116 - RNA, 19 nt, Artificial Sequence
  Synthetic
uauauauauuagugucaua

SEQ ID NO: 117 - RNA, 19 nt, Artificial Sequence
  Synthetic
auauauauuagugucauaa

SEQ ID NO: 118 - RNA, 19 nt, Artificial Sequence
  Synthetic
ugggacaaaauggauccca

SEQ ID NO: 119 - RNA, 19 nt, Artificial Sequence
  Synthetic
gggacaaaauggaucccau

SEQ ID NO: 120 - RNA, 19 nt, Artificial Sequence
  Synthetic
ggacaaaauggaucccauu

SEQ ID NO: 121 - RNA, 19 nt, Artificial Sequence
  Synthetic
gacaaaauggaucccauua

SEQ ID NO: 122 - RNA, 19 nt, Artificial Sequence
  Synthetic
acaaaauggaucccauuau

SEQ ID NO: 123 - RNA, 19 nt, Artificial Sequence
  Synthetic
caaaauggaucccauuauu

SEQ ID NO: 124 - RNA, 19 nt, Artificial Sequence
  Synthetic
aaaauggaucccauuauua

SEQ ID NO: 125 - RNA, 19 nt, Artificial Sequence
  Synthetic
aaauggaucccauuauuaa

SEQ ID NO: 126 - RNA, 19 nt, Artificial Sequence
  Synthetic
aauggaucccauuauuaau

SEQ ID NO: 127 - RNA, 19 nt, Artificial Sequence
  Synthetic
auggaucccauuauuaaug

SEQ ID NO: 128 - RNA, 19 nt, Artificial Sequence
  Synthetic
uggaucccauuauuaaugg

SEQ ID NO: 129 - RNA, 19 nt, Artificial Sequence
  Synthetic
ggaucccauuauuaaugga

SEQ ID NO: 130 - RNA, 19 nt, Artificial Sequence
  Synthetic
gaucccauuauuaauggaa

SEQ ID NO: 131 - RNA, 19 nt, Artificial Sequence
  Synthetic
aucccauuauuaauggaaa

SEQ ID NO: 132 - RNA, 19 nt, Artificial Sequence
  Synthetic
aacuuaauuaguagacaaa

SEQ ID NO: 133 - RNA, 19 nt, Artificial Sequence
  Synthetic
cagucauuacuuaugacau

SEQ ID NO: 134 - RNA, 19 nt, Artificial Sequence
  Synthetic
agucauuacuuaugacaua

SEQ ID NO: 135 - RNA, 19 nt, Artificial Sequence
  Synthetic
aucaaaacaacacucuuga

SEQ ID NO: 136 - RNA, 19 nt, Artificial Sequence
  Synthetic
ucaaaacaacacucuugaa

SEQ ID NO: 137 - RNA, 19 nt, Artificial Sequence
  Synthetic
cauccuccaucaugguuaa

SEQ ID NO: 138 - RNA, 19 nt, Artificial Sequence
  Synthetic
auccuccaucaugguuaau

SEQ ID NO: 139 - RNA, 19 nt, Artificial Sequence
  Synthetic
uccuccaucaugguuaaua

SEQ ID NO: 140 - RNA, 19 nt, Artificial Sequence
  Synthetic
ccuccaucaugguuaauac

SEQ ID NO: 141 - RNA, 19 nt, Artificial Sequence
  Synthetic
cuccaucaugguuaauaca

SEQ ID NO: 142 - RNA, 19 nt, Artificial Sequence
  Synthetic
acauuaaauaaaagcuuag

SEQ ID NO: 143 - RNA, 19 nt, Artificial Sequence
  Synthetic
cauuaaauaaaagcuuagg

SEQ ID NO: 144 - RNA, 19 nt, Artificial Sequence
  Synthetic
guagagggauuuauuaugu

SEQ ID NO: 145 - RNA, 19 nt, Artificial Sequence
  Synthetic
uagagggauuuauuauguc

SEQ ID NO: 146 - RNA, 19 nt, Artificial Sequence
  Synthetic
agagggauuuauuaugucu

SEQ ID NO: 147 - RNA, 19 nt, Artificial Sequence
  Synthetic
auaacagaagaagaucaau

SEQ ID NO: 148 - RNA, 19 nt, Artificial Sequence
  Synthetic
uaacagaagaagaucaauu

SEQ ID NO: 149 - RNA, 19 nt, Artificial Sequence
  Synthetic
ugccuaaaaaaguggaucu

SEQ ID NO: 150 - RNA, 19 nt, Artificial Sequence
  Synthetic
gccuaaaaaaguggaucuu

SEQ ID NO: 151 - RNA, 19 nt, Artificial Sequence
  Synthetic
ccuaaaaaaguggaucuug

SEQ ID NO: 152 - RNA, 19 nt, Artificial Sequence
  Synthetic
cuaaaaaaguggaucuuga

SEQ ID NO: 153 - RNA, 19 nt, Artificial Sequence
  Synthetic
uaaaaaaguggaucuugaa

SEQ ID NO: 154 - RNA, 19 nt, Artificial Sequence
  Synthetic
aaaaaaguggaucuugaaa

SEQ ID NO: 155 - RNA, 19 nt, Artificial Sequence
  Synthetic
aaaaaguggaucuugaaau

SEQ ID NO: 156 - RNA, 19 nt, Artificial Sequence
  Synthetic
aaaaguggaucuugaaaug

SEQ ID NO: 157 - RNA, 19 nt, Artificial Sequence
  Synthetic
aaaguggaucuugaaauga

SEQ ID NO: 158 - RNA, 19 nt, Artificial Sequence
  Synthetic
aaguggaucuugaaaugau

SEQ ID NO: 159 - RNA, 19 nt, Artificial Sequence
  Synthetic
cucaguguagguagaaugu

SEQ ID NO: 160 - RNA, 19 nt, Artificial Sequence
  Synthetic
ucaguguagguagaauguu

SEQ ID NO: 161 - RNA, 19 nt, Artificial Sequence
  Synthetic
caguguagguagaauguuu

SEQ ID NO: 162 - RNA, 19 nt, Artificial Sequence
  Synthetic
aguguagguagaauguuug

SEQ ID NO: 163 - RNA, 19 nt, Artificial Sequence
  Synthetic
guguagguagaauguuugc

SEQ ID NO: 164 - RNA, 19 nt, Artificial Sequence
  Synthetic
acaagauauggugaucuag

SEQ ID NO: 165 - RNA, 19 nt, Artificial Sequence
  Synthetic
caagauauggugaucuaga

SEQ ID NO: 166 - RNA, 19 nt, Artificial Sequence
  Synthetic
agcaaauucaaucaagcau

SEQ ID NO: 167 - RNA, 19 nt, Artificial Sequence
  Synthetic
gcaaauucaaucaagcauu

SEQ ID NO: 168 - RNA, 19 nt, Artificial Sequence
  Synthetic
caaauucaaucaagcauuu

SEQ ID NO: 169 - RNA, 19 nt, Artificial Sequence
  Synthetic
gaugaacaaaguggauuau

SEQ ID NO: 170 - RNA, 19 nt, Artificial Sequence
  Synthetic
augaacaaaguggauuaua

SEQ ID NO: 171 - RNA, 19 nt, Artificial Sequence
  Synthetic
uauuaugcaguuuaauauu

SEQ ID NO: 172 - RNA, 19 nt, Artificial Sequence
  Synthetic
auuaugcaguuuaauauuu

SEQ ID NO: 173 - RNA, 19 nt, Artificial Sequence
  Synthetic
uuaugcaguuuaauauuua

SEQ ID NO: 174 - RNA, 19 nt, Artificial Sequence
  Synthetic
uaugcaguuuaauauuuag

SEQ ID NO: 175 - RNA, 19 nt, Artificial Sequence
  Synthetic
auuaugcaaaauauagaac

SEQ ID NO: 176 - RNA, 19 nt, Artificial Sequence
  Synthetic
uuaugcaaaauauagaacc

SEQ ID NO: 177 - RNA, 19 nt, Artificial Sequence
  Synthetic
uaagaguuguuuaugaaag

SEQ ID NO: 178 - RNA, 19 nt, Artificial Sequence
  Synthetic
aagaguuguuuaugaaagu

SEQ ID NO: 179 - RNA, 19 nt, Artificial Sequence
  Synthetic
gagaaaaaaacaaugccag

SEQ ID NO: 180 - RNA, 19 nt, Artificial Sequence
  Synthetic
agaaaaaaacaaugccagu

SEQ ID NO: 181 - RNA, 19 nt, Artificial Sequence
  Synthetic
gaugaauucauggaagaac

SEQ ID NO: 182 - RNA, 19 nt, Artificial Sequence
  Synthetic
augaauucauggaagaacu

SEQ ID NO: 183 - RNA, 19 nt, Artificial Sequence
  Synthetic
ccaugugaauucccugcau

SEQ ID NO: 184 - RNA, 19 nt, Artificial Sequence
  Synthetic
caugugaauucccugcauc

SEQ ID NO: 185 - RNA, 19 nt, Artificial Sequence
  Synthetic
augugaauucccugcauca

SEQ ID NO: 186 - RNA, 19 nt, Artificial Sequence
  Synthetic
ugugaauucccugcaucaa

SEQ ID NO: 187 - RNA, 19 nt, Artificial Sequence
  Synthetic
gugaauucccugcaucaau

SEQ ID NO: 188 - RNA, 19 nt, Artificial Sequence
  Synthetic
ugaauucccugcaucaaua

SEQ ID NO: 189 - RNA, 19 nt, Artificial Sequence
  Synthetic
gaauucccugcaucaauac

SEQ ID NO: 190 - RNA, 19 nt, Artificial Sequence
  Synthetic
aauucccugcaucaauacc

SEQ ID NO: 191 - RNA, 19 nt, Artificial Sequence
  Synthetic
auucccugcaucaauacca

SEQ ID NO: 192 - RNA, 19 nt, Artificial Sequence
  Synthetic
uucccugcaucaauaccag

SEQ ID NO: 193 - RNA, 19 nt, Artificial Sequence
  Synthetic
ucccugcaucaauaccagc

SEQ ID NO: 194 - RNA, 19 nt, Artificial Sequence
  Synthetic
cccugcaucaauaccagcu

SEQ ID NO: 195 - RNA, 19 nt, Artificial Sequence
  Synthetic
ccugcaucaauaccagcuu

SEQ ID NO: 196 - RNA, 19 nt, Artificial Sequence
  Synthetic
cugcaucaauaccagcuua

SEQ ID NO: 197 - RNA, 19 nt, Artificial Sequence
  Synthetic
ugcaucaauaccagcuuau

SEQ ID NO: 198 - RNA, 19 nt, Artificial Sequence
  Synthetic
gcaucaauaccagcuuaua

SEQ ID NO: 199 - RNA, 19 nt, Artificial Sequence
  Synthetic
caucaauaccagcuuauag

SEQ ID NO: 200 - RNA, 19 nt, Artificial Sequence
  Synthetic
aucaauaccagcuuauaga

SEQ ID NO: 201 - RNA, 19 nt, Artificial Sequence
  Synthetic
ucaauaccagcuuauagaa

SEQ ID NO: 202 - RNA, 19 nt, Artificial Sequence
  Synthetic
caauaccagcuuauagaac

SEQ ID NO: 203 - RNA, 19 nt, Artificial Sequence
  Synthetic
uauuaacagaaaaguaugg

SEQ ID NO: 204 - RNA, 19 nt, Artificial Sequence
  Synthetic
caagugauacaaaaacagc

SEQ ID NO: 205 - RNA, 19 nt, Artificial Sequence
  Synthetic
aagugauacaaaaacagca

SEQ ID NO: 206 - RNA, 19 nt, Artificial Sequence
  Synthetic
auuuuaaguacuaauuuag

SEQ ID NO: 207 - RNA, 19 nt, Artificial Sequence
  Synthetic
uuuuaaguacuaauuuagc

SEQ ID NO: 208 - RNA, 19 nt, Artificial Sequence
  Synthetic
uuuaaguacuaauuuagcu

SEQ ID NO: 209 - RNA, 19 nt, Artificial Sequence
  Synthetic
uuaaguacuaauuuagcug

SEQ ID NO: 210 - RNA, 19 nt, Artificial Sequence
  Synthetic
uaaguacuaauuuagcugg

SEQ ID NO: 211 - RNA, 19 nt, Artificial Sequence
  Synthetic
aaguacuaauuuagcugga

SEQ ID NO: 212 - RNA, 19 nt, Artificial Sequence
  Synthetic
aguacuaauuuagcuggac

SEQ ID NO: 213 - RNA, 19 nt, Artificial Sequence
  Synthetic
guacuaauuuagcuggaca

SEQ ID NO: 214 - RNA, 19 nt, Artificial Sequence
  Synthetic
uacuaauuuagcuggacau

SEQ ID NO: 215 - RNA, 19 nt, Artificial Sequence
  Synthetic
acuaauuuagcuggacauu

SEQ ID NO: 216 - RNA, 19 nt, Artificial Sequence
  Synthetic
cuaauuuagcuggacauug

SEQ ID NO: 217 - RNA, 19 nt, Artificial Sequence
  Synthetic
uaauuuagcuggacauugg

SEQ ID NO: 218 - RNA, 19 nt, Artificial Sequence
  Synthetic
aauuuagcuggacauugga

SEQ ID NO: 219 - RNA, 19 nt, Artificial Sequence
  Synthetic
auuuagcuggacauuggau

SEQ ID NO: 220 - RNA, 19 nt, Artificial Sequence
  Synthetic
uuuagcuggacauuggauu

SEQ ID NO: 221 - RNA, 19 nt, Artificial Sequence
  Synthetic
uuagcuggacauuggauuc

SEQ ID NO: 222 - RNA, 19 nt, Artificial Sequence
  Synthetic
uagcuggacauuggauucu

SEQ ID NO: 223 - RNA, 19 nt, Artificial Sequence
  Synthetic
gguauuuuugaaaaagauu

SEQ ID NO: 224 - RNA, 19 nt, Artificial Sequence
  Synthetic
guauuuuugaaaaagauug

SEQ ID NO: 225 - RNA, 19 nt, Artificial Sequence
  Synthetic
uauuuuugaaaaagauugg

SEQ ID NO: 226 - RNA, 19 nt, Artificial Sequence
  Synthetic
auuuuugaaaaagauuggg

SEQ ID NO: 227 - RNA, 19 nt, Artificial Sequence
  Synthetic
uuuuugaaaaagauugggg

SEQ ID NO: 228 - RNA, 19 nt, Artificial Sequence
  Synthetic
uuuugaaaaagauugggga

SEQ ID NO: 229 - RNA, 19 nt, Artificial Sequence
  Synthetic
uuugaaaaagauuggggag

SEQ ID NO: 230 - RNA, 19 nt, Artificial Sequence
  Synthetic
uugaaaaagauuggggaga

SEQ ID NO: 231 - RNA, 19 nt, Artificial Sequence
  Synthetic
ugaaaaagauuggggagag

SEQ ID NO: 232 - RNA, 19 nt, Artificial Sequence
  Synthetic
gaaaaagauuggggagagg

SEQ ID NO: 233 - RNA, 19 nt, Artificial Sequence
  Synthetic
aaaaagauuggggagaggg

SEQ ID NO: 234 - RNA, 19 nt, Artificial Sequence
  Synthetic
ugcccuuggguuguuaaca

SEQ ID NO: 235 - RNA, 19 nt, Artificial Sequence
  Synthetic
gcccuuggguuguuaacau

SEQ ID NO: 236 - RNA, 19 nt, Artificial Sequence
  Synthetic
cccuuggguuguuaacaua

SEQ ID NO: 237 - RNA, 19 nt, Artificial Sequence
  Synthetic
ccuuggguuguuaacauag

SEQ ID NO: 238 - RNA, 19 nt, Artificial Sequence
  Synthetic
cuuggguuguuaacauaga

SEQ ID NO: 239 - RNA, 19 nt, Artificial Sequence
  Synthetic
uuggguuguuaacauagau

SEQ ID NO: 240 - RNA, 19 nt, Artificial Sequence
  Synthetic
uggguuguuaacauagauu

SEQ ID NO: 241 - RNA, 19 nt, Artificial Sequence
  Synthetic
ggguuguuaacauagauua

SEQ ID NO: 242 - RNA, 19 nt, Artificial Sequence
  Synthetic
gguuguuaacauagauuau

SEQ ID NO: 243 - RNA, 19 nt, Artificial Sequence
  Synthetic
guuguuaacauagauuauc

SEQ ID NO: 244 - RNA, 19 nt, Artificial Sequence
  Synthetic
uuguuaacauagauuauca

SEQ ID NO: 245 - RNA, 19 nt, Artificial Sequence
  Synthetic
acaaauucaaugaugaauu

SEQ ID NO: 246 - RNA, 19 nt, Artificial Sequence
  Synthetic
caaauucaaugaugaauuu

SEQ ID NO: 247 - RNA, 19 nt, Artificial Sequence
  Synthetic
aaauucaaugaugaauuuu

SEQ ID NO: 248 - RNA, 19 nt, Artificial Sequence
  Synthetic
aauucaaugaugaauuuua

SEQ ID NO: 249 - RNA, 19 nt, Artificial Sequence
  Synthetic
ugcaugcuuccuuggcauc

SEQ ID NO: 250 - RNA, 19 nt, Artificial Sequence
  Synthetic
gcaugcuuccuuggcauca

SEQ ID NO: 251 - RNA, 19 nt, Artificial Sequence
  Synthetic
caugcuuccuuggcaucau

SEQ ID NO: 252 - RNA, 19 nt, Artificial Sequence
  Synthetic
aguauagaguauauuuuaa

SEQ ID NO: 253 - RNA, 19 nt, Artificial Sequence
  Synthetic
guauagaguauauuuuaaa

SEQ ID NO: 254 - RNA, 19 nt, Artificial Sequence
  Synthetic
uauagaguauauuuuaaaa

SEQ ID NO: 255 - RNA, 19 nt, Artificial Sequence
  Synthetic
auagaguauauuuuaaaag

SEQ ID NO: 256 - RNA, 19 nt, Artificial Sequence
  Synthetic
uagaguauauuuuaaaaga

SEQ ID NO: 257 - RNA, 19 nt, Artificial Sequence
  Synthetic
uuguauagcauucauaggu

SEQ ID NO: 258 - RNA, 19 nt, Artificial Sequence
  Synthetic
uguauagcauucauaggug

SEQ ID NO: 259 - RNA, 19 nt, Artificial Sequence
  Synthetic
guauagcauucauagguga

SEQ ID NO: 260 - RNA, 19 nt, Artificial Sequence
  Synthetic
uauagcauucauaggugaa

SEQ ID NO: 261 - RNA, 19 nt, Artificial Sequence
  Synthetic
auagcauucauaggugaag

SEQ ID NO: 262 - RNA, 19 nt, Artificial Sequence
  Synthetic
uagcauucauaggugaagg

SEQ ID NO: 263 - RNA, 19 nt, Artificial Sequence
  Synthetic
agcauucauaggugaagga

SEQ ID NO: 264 - RNA, 19 nt, Artificial Sequence
  Synthetic
gcauucauaggugaaggag

SEQ ID NO: 265 - RNA, 19 nt, Artificial Sequence
  Synthetic
cauucauaggugaaggagc

SEQ ID NO: 266 - RNA, 19 nt, Artificial Sequence
  Synthetic
accauuccugcuacagaug

SEQ ID NO: 267 - RNA, 19 nt, Artificial Sequence
  Synthetic
ccauuccugcuacagaugc

SEQ ID NO: 268 - RNA, 19 nt, Artificial Sequence
  Synthetic
cauuccugcuacagaugca

SEQ ID NO: 269 - RNA, 19 nt, Artificial Sequence
  Synthetic
auuccugcuacagaugcaa

SEQ ID NO: 270 - RNA, 19 nt, Artificial Sequence
  Synthetic
uuccugcuacagaugcaac

SEQ ID NO: 271 - RNA, 19 nt, Artificial Sequence
  Synthetic
aacauucauuggucuuauu

SEQ ID NO: 272 - RNA, 19 nt, Artificial Sequence
  Synthetic
acauucauuggucuuauuu

SEQ ID NO: 273 - RNA, 19 nt, Artificial Sequence
  Synthetic
cauucauuggucuuauuua

SEQ ID NO: 274 - RNA, 19 nt, Artificial Sequence
  Synthetic
auucauuggucuuauuuac

SEQ ID NO: 275 - RNA, 19 nt, Artificial Sequence
  Synthetic
uucauuggucuuauuuaca

SEQ ID NO: 276 - RNA, 19 nt, Artificial Sequence
  Synthetic
ucauuggucuuauuuacau

SEQ ID NO: 277 - RNA, 19 nt, Artificial Sequence
  Synthetic
cauuggucuuauuuacaua

SEQ ID NO: 278 - RNA, 19 nt, Artificial Sequence
  Synthetic
auuggucuuauuuacauau

SEQ ID NO: 279 - RNA, 19 nt, Artificial Sequence
  Synthetic
uuggucuuauuuacauaua

SEQ ID NO: 280 - RNA, 19 nt, Artificial Sequence
  Synthetic
uggucuuauuuacauauaa

SEQ ID NO: 281 - RNA, 19 nt, Artificial Sequence
  Synthetic
ggucuuauuuacauauaaa

SEQ ID NO: 282 - RNA, 19 nt, Artificial Sequence
  Synthetic
aaaauaucaugcucaagau

SEQ ID NO: 283 - RNA, 19 nt, Artificial Sequence
  Synthetic
aaauaucaugcucaagaug

SEQ ID NO: 284 - RNA, 19 nt, Artificial Sequence
  Synthetic
aauaucaugcucaagauga

SEQ ID NO: 285 - RNA, 19 nt, Artificial Sequence
  Synthetic
auaucaugcucaagaugau

SEQ ID NO: 286 - RNA, 19 nt, Artificial Sequence
  Synthetic
uaucaugcucaagaugaua

SEQ ID NO: 287 - RNA, 19 nt, Artificial Sequence
  Synthetic
aucaugcucaagaugauau

SEQ ID NO: 288 - RNA, 19 nt, Artificial Sequence
  Synthetic
guuuacuuaguccuuacaa

SEQ ID NO: 289 - RNA, 19 nt, Artificial Sequence
  Synthetic
uuuacuuaguccuuacaau

SEQ ID NO: 290 - RNA, 19 nt, Artificial Sequence
  Synthetic
uuacuuaguccuuacaaua

SEQ ID NO: 291 - RNA, 19 nt, Artificial Sequence
  Synthetic
uacuuaguccuuacaauag

SEQ ID NO: 292 - RNA, 19 nt, Artificial Sequence
  Synthetic
acuuaguccuuacaauagg

SEQ ID NO: 293 - RNA, 19 nt, Artificial Sequence
  Synthetic
cuuuguuacccuauaacaa

SEQ ID NO: 294 - RNA, 19 nt, Artificial Sequence
  Synthetic
uuuguuacccuauaacaaa

SEQ ID NO: 295 - RNA, 19 nt, Artificial Sequence
  Synthetic
uuguuacccuauaacaaaa

SEQ ID NO: 296 - RNA, 19 nt, Artificial Sequence
  Synthetic
uguuacccuauaacaaaaa

SEQ ID NO: 297 - RNA, 19 nt, Artificial Sequence
  Synthetic
guuacccuauaacaaaaaa

SEQ ID NO: 298 - RNA, 19 nt, Artificial Sequence
  Synthetic
uuacccuauaacaaaaaaa

SEQ ID NO: 299 - RNA, 19 nt, Artificial Sequence
  Synthetic
uacccuauaacaaaaaaag

SEQ ID NO: 300 - RNA, 19 nt, Artificial Sequence
  Synthetic
acccuauaacaaaaaaagg

SEQ ID NO: 301 - RNA, 19 nt, Artificial Sequence
  Synthetic
cccuauaacaaaaaaagga

SEQ ID NO: 302 - RNA, 19 nt, Artificial Sequence
  Synthetic
ccuauaacaaaaaaaggaa

SEQ ID NO: 303 - RNA, 19 nt, Artificial Sequence
  Synthetic
cuauaacaaaaaaaggaau

SEQ ID NO: 304 - RNA, 19 nt, Artificial Sequence
  Synthetic
uauaacaaaaaaaggaauu

SEQ ID NO: 305 - RNA, 19 nt, Artificial Sequence
  Synthetic
auaacaaaaaaaggaauua

SEQ ID NO: 306 - RNA, 19 nt, Artificial Sequence
  Synthetic
uaacaaaaaaaggaauuaa

SEQ ID NO: 307 - RNA, 19 nt, Artificial Sequence
  Synthetic
auuaguuuuugacacuuuu

SEQ ID NO: 308 - RNA, 19 nt, Artificial Sequence
  Synthetic
uuaguuuuugacacuuuuu

SEQ ID NO: 309 - RNA, 19 nt, Artificial Sequence
  Synthetic
uaguuuuugacacuuuuuu

SEQ ID NO: 310 - RNA, 19 nt, Artificial Sequence
  Synthetic
aguuuuugacacuuuuuuu

SEQ ID NO: 311 - RNA, 19 nt, Artificial Sequence
  Synthetic
guuuuugacacuuuuuuuc

SEQ ID NO: 312 - RNA, 19 nt, Artificial Sequence
  Synthetic
uuuuugacacuuuuuuucu

SEQ ID NO: 313 - RNA, 19 nt, Artificial Sequence
  Synthetic
uuuugacacuuuuuuucuc

SEQ ID NO: 314 - RNA, 19 nt, Artificial Sequence
  Synthetic
ugagauagaaucuagaaaa

SEQ ID NO: 315 - RNA, 19 nt, Artificial Sequence
  Synthetic
gagauagaaucuagaaaau

SEQ ID NO: 316 - RNA, 19 nt, Artificial Sequence
  Synthetic
agauagaaucuagaaaauc

SEQ ID NO: 317 - RNA, 19 nt, Artificial Sequence
  Synthetic
gauagaaucuagaaaaucc

SEQ ID NO: 318 - RNA, 19 nt, Artificial Sequence
  Synthetic
auagaaucuagaaaauccu

SEQ ID NO: 319 - RNA, 19 nt, Artificial Sequence
  Synthetic
uagaaucuagaaaauccua

SEQ ID NO: 320 - RNA, 19 nt, Artificial Sequence
  Synthetic
agaaucuagaaaauccuac

SEQ ID NO: 321 - RNA, 19 nt, Artificial Sequence
  Synthetic
gaaucuagaaaauccuaca

SEQ ID NO: 322 - RNA, 19 nt, Artificial Sequence
  Synthetic
aaucuagaaaauccuacaa

SEQ ID NO: 323 - RNA, 19 nt, Artificial Sequence
  Synthetic
aucuagaaaauccuacaaa

SEQ ID NO: 324 - RNA, 19 nt, Artificial Sequence
  Synthetic
ucuagaaaauccuacaaaa

SEQ ID NO: 325 - RNA, 19 nt, Artificial Sequence
  Synthetic
cuagaaaauccuacaaaaa

SEQ ID NO: 326 - RNA, 19 nt, Artificial Sequence
  Synthetic
uagaaaauccuacaaaaaa

SEQ ID NO: 327 - RNA, 19 nt, Artificial Sequence
  Synthetic
agaaaauccuacaaaaaaa

SEQ ID NO: 328 - RNA, 19 nt, Artificial Sequence
  Synthetic
gaaaauccuacaaaaaaau

SEQ ID NO: 329 - RNA, 19 nt, Artificial Sequence
  Synthetic
aaaauccuacaaaaaaaug

SEQ ID NO: 330 - RNA, 19 nt, Artificial Sequence
  Synthetic
aaauccuacaaaaaaaugc

SEQ ID NO: 331 - RNA, 19 nt, Artificial Sequence
  Synthetic
aauccuacaaaaaaaugcu

SEQ ID NO: 332 - RNA, 19 nt, Artificial Sequence
  Synthetic
auccuacaaaaaaaugcua

SEQ ID NO: 333 - RNA, 19 nt, Artificial Sequence
  Synthetic
ggauuguuuaugaaugccu

SEQ ID NO: 334 - RNA, 19 nt, Artificial Sequence
  Synthetic
gauuguuuaugaaugccua

SEQ ID NO: 335 - RNA, 19 nt, Artificial Sequence
  Synthetic
auuguuuaugaaugccuau

SEQ ID NO: 336 - RNA, 19 nt, Artificial Sequence
  Synthetic
uuguuuaugaaugccuaug

SEQ ID NO: 337 - RNA, 19 nt, Artificial Sequence
  Synthetic
uguuuaugaaugccuaugg

SEQ ID NO: 338 - RNA, 19 nt, Artificial Sequence
  Synthetic
guuuaugaaugccuauggu

SEQ ID NO: 339 - RNA, 19 nt, Artificial Sequence
  Synthetic
aauagauauagaaguaacc

SEQ ID NO: 340 - RNA, 19 nt, Artificial Sequence
  Synthetic
auagauauagaaguaacca

SEQ ID NO: 341 - RNA, 19 nt, Artificial Sequence
  Synthetic
uagauauagaaguaaccaa

SEQ ID NO: 342 - RNA, 19 nt, Artificial Sequence
  Synthetic
agauauagaaguaaccaaa

SEQ ID NO: 343 - RNA, 19 nt, Artificial Sequence
  Synthetic
gauauagaaguaaccaaag

SEQ ID NO: 344 - RNA, 19 nt, Artificial Sequence
  Synthetic
auauagaaguaaccaaaga

SEQ ID NO: 345 - RNA, 19 nt, Artificial Sequence
  Synthetic
auagaaacauuugauaaca

SEQ ID NO: 346 - RNA, 19 nt, Artificial Sequence
  Synthetic
uagaaacauuugauaacaa

SEQ ID NO: 347 - RNA, 19 nt, Artificial Sequence
  Synthetic
agaaacauuugauaacaau

SEQ ID NO: 348 - RNA, 19 nt, Artificial Sequence
  Synthetic
gaaacauuugauaacaaug

SEQ ID NO: 349 - RNA, 19 nt, Artificial Sequence
  Synthetic
aaacauuugauaacaauga

SEQ ID NO: 350 - RNA, 19 nt, Artificial Sequence
  Synthetic
aacauuugauaacaaugaa

SEQ ID NO: 351 - RNA, 19 nt, Artificial Sequence
  Synthetic
uggcaaugauaaucucaac

SEQ ID NO: 352 - RNA, 19 nt, Artificial Sequence
  Synthetic
auaaaacaagaauuagaua

SEQ ID NO: 353 - RNA, 19 nt, Artificial Sequence
  Synthetic
uaaaacaagaauuagauaa

SEQ ID NO: 354 - RNA, 19 nt, Artificial Sequence
  Synthetic
aucaaugauaugccuauaa

SEQ ID NO: 355 - RNA, 19 nt, Artificial Sequence
  Synthetic
ucaaugauaugccuauaac

SEQ ID NO: 356 - RNA, 19 nt, Artificial Sequence
  Synthetic
caaugauaugccuauaaca

SEQ ID NO: 357 - RNA, 19 nt, Artificial Sequence
  Synthetic
aaugauaugccuauaacaa

SEQ ID NO: 358 - RNA, 19 nt, Artificial Sequence
  Synthetic
augauaugccuauaacaaa

SEQ ID NO: 359 - RNA, 19 nt, Artificial Sequence
  Synthetic
ugauaugccuauaacaaau

SEQ ID NO: 360 - RNA, 19 nt, Artificial Sequence
  Synthetic
gauaugccuauaacaaaug

SEQ ID NO: 361 - RNA, 19 nt, Artificial Sequence
  Synthetic
auaugccuauaacaaauga

SEQ ID NO: 362 - RNA, 19 nt, Artificial Sequence
  Synthetic
uaugccuauaacaaaugau

SEQ ID NO: 363 - RNA, 19 nt, Artificial Sequence
  Synthetic
augccuauaacaaaugauc

SEQ ID NO: 364 - RNA, 19 nt, Artificial Sequence
  Synthetic
ugccuauaacaaaugauca

SEQ ID NO: 365 - RNA, 19 nt, Artificial Sequence
  Synthetic
gccuauaacaaaugaucag

SEQ ID NO: 366 - RNA, 19 nt, Artificial Sequence
  Synthetic
ccuauaacaaaugaucaga

SEQ ID NO: 367 - RNA, 19 nt, Artificial Sequence
  Synthetic
cuauaacaaaugaucagaa

SEQ ID NO: 368 - RNA, 19 nt, Artificial Sequence
  Synthetic
uauaacaaaugaucagaaa

SEQ ID NO: 369 - RNA, 19 nt, Artificial Sequence
  Synthetic
acaauauauauauuagugu

SEQ ID NO: 370 - RNA, 19 nt, Artificial Sequence
  Synthetic
caauauauauauuaguguc

SEQ ID NO: 371 - RNA, 19 nt, Artificial Sequence
  Synthetic
aauauauauauuaguguca

SEQ ID NO: 372 - RNA, 19 nt, Artificial Sequence
  Synthetic
auauauauauuagugucau

SEQ ID NO: 373 - RNA, 19 nt, Artificial Sequence
  Synthetic
gauaguuauuuaaaaggug

SEQ ID NO: 374 - RNA, 19 nt, Artificial Sequence
  Synthetic
auaguuauuuaaaaggugu

SEQ ID NO: 375 - RNA, 19 nt, Artificial Sequence
  Synthetic
uaguuauuuaaaagguguu

SEQ ID NO: 376 - RNA, 19 nt, Artificial Sequence
  Synthetic
aguuauuuaaaagguguua

SEQ ID NO: 377 - RNA, 19 nt, Artificial Sequence
  Synthetic
guuauuuaaaagguguuau

SEQ ID NO: 378 - RNA, 19 nt, Artificial Sequence
  Synthetic
ccuuaucucaaaaaugauu

SEQ ID NO: 379 - RNA, 19 nt, Artificial Sequence
  Synthetic
cuuaucucaaaaaugauua

SEQ ID NO: 380 - RNA, 19 nt, Artificial Sequence
  Synthetic
accaacuuaauuaguagac

SEQ ID NO: 381 - RNA, 19 nt, Artificial Sequence
  Synthetic
ccaacuuaauuaguagaca

SEQ ID NO: 382 - RNA, 19 nt, Artificial Sequence
  Synthetic
caacuuaauuaguagacaa

SEQ ID NO: 383 - RNA, 19 nt, Artificial Sequence
  Synthetic
auguguucaaugcaacauc

SEQ ID NO: 384 - RNA, 19 nt, Artificial Sequence
  Synthetic
uguguucaaugcaacaucc

SEQ ID NO: 385 - RNA, 19 nt, Artificial Sequence
  Synthetic
guguucaaugcaacauccu

SEQ ID NO: 386 - RNA, 19 nt, Artificial Sequence
  Synthetic
uguucaaugcaacauccuc

SEQ ID NO: 387 - RNA, 19 nt, Artificial Sequence
  Synthetic
guucaaugcaacauccucc

SEQ ID NO: 388 - RNA, 19 nt, Artificial Sequence
  Synthetic
uucaaugcaacauccucca

SEQ ID NO: 389 - RNA, 19 nt, Artificial Sequence
  Synthetic
ucaaugcaacauccuccau

SEQ ID NO: 390 - RNA, 19 nt, Artificial Sequence
  Synthetic
caaugcaacauccuccauc

SEQ ID NO: 391 - RNA, 19 nt, Artificial Sequence
  Synthetic
aaugcaacauccuccauca

SEQ ID NO: 392 - RNA, 19 nt, Artificial Sequence
  Synthetic
augcaacauccuccaucau

SEQ ID NO: 393 - RNA, 19 nt, Artificial Sequence
  Synthetic
ugcaacauccuccaucaug

SEQ ID NO: 394 - RNA, 19 nt, Artificial Sequence
  Synthetic
gcaacauccuccaucaugg

SEQ ID NO: 395 - RNA, 19 nt, Artificial Sequence
  Synthetic
caacauccuccaucauggu

SEQ ID NO: 396 - RNA, 19 nt, Artificial Sequence
  Synthetic
aacauccuccaucaugguu

SEQ ID NO: 397 - RNA, 19 nt, Artificial Sequence
  Synthetic
acauccuccaucaugguua

SEQ ID NO: 398 - RNA, 19 nt, Artificial Sequence
  Synthetic
gaucuaauaucucucaaag

SEQ ID NO: 399 - RNA, 19 nt, Artificial Sequence
  Synthetic
aucuaauaucucucaaagg

SEQ ID NO: 400 - RNA, 19 nt, Artificial Sequence
  Synthetic
ucuaauaucucucaaaggg

SEQ ID NO: 401 - RNA, 19 nt, Artificial Sequence
  Synthetic
cuaauaucucucaaaggga

SEQ ID NO: 402 - RNA, 19 nt, Artificial Sequence
  Synthetic
uaauaucucucaaagggaa

SEQ ID NO: 403 - RNA, 19 nt, Artificial Sequence
  Synthetic
aauaucucucaaagggaaa

SEQ ID NO: 404 - RNA, 19 nt, Artificial Sequence
  Synthetic
auaucucucaaagggaaau

SEQ ID NO: 405 - RNA, 19 nt, Artificial Sequence
  Synthetic
uaucucucaaagggaaauu

SEQ ID NO: 406 - RNA, 19 nt, Artificial Sequence
  Synthetic
aucucucaaagggaaauuc

SEQ ID NO: 407 - RNA, 19 nt, Artificial Sequence
  Synthetic
ucucucaaagggaaauucu

SEQ ID NO: 408 - RNA, 19 nt, Artificial Sequence
  Synthetic
cucucaaagggaaauucuc

SEQ ID NO: 409 - RNA, 19 nt, Artificial Sequence
  Synthetic
acagucaguaguagaccau

SEQ ID NO: 410 - RNA, 19 nt, Artificial Sequence
  Synthetic
cagucaguaguagaccaug

SEQ ID NO: 411 - RNA, 19 nt, Artificial Sequence
  Synthetic
agucaguaguagaccaugu

SEQ ID NO: 412 - RNA, 19 nt, Artificial Sequence
  Synthetic
gucaguaguagaccaugug

SEQ ID NO: 413 - RNA, 19 nt, Artificial Sequence
  Synthetic
ucaguaguagaccauguga

SEQ ID NO: 414 - RNA, 19 nt, Artificial Sequence
  Synthetic
caguaguagaccaugugaa

SEQ ID NO: 415 - RNA, 19 nt, Artificial Sequence
  Synthetic
aguaguagaccaugugaau

SEQ ID NO: 416 - RNA, 19 nt, Artificial Sequence
  Synthetic
guaguagaccaugugaauu

SEQ ID NO: 417 - RNA, 19 nt, Artificial Sequence
  Synthetic
uaguagaccaugugaauuc

SEQ ID NO: 418 - RNA, 19 nt, Artificial Sequence
  Synthetic
aguagaccaugugaauucc

SEQ ID NO: 419 - RNA, 19 nt, Artificial Sequence
  Synthetic
guagaccaugugaauuccc

SEQ ID NO: 420 - RNA, 19 nt, Artificial Sequence
  Synthetic
uagaccaugugaauucccu

SEQ ID NO: 421 - RNA, 19 nt, Artificial Sequence
  Synthetic
agaccaugugaauucccug

SEQ ID NO: 422 - RNA, 19 nt, Artificial Sequence
  Synthetic
gaccaugugaauucccugc

SEQ ID NO: 423 - RNA, 19 nt, Artificial Sequence
  Synthetic
accaugugaauucccugca

SEQ ID NO: 424 - RNA, 19 nt, Artificial Sequence
  Synthetic
agugauacaaaaacagcau

SEQ ID NO: 425 - RNA, 19 nt, Artificial Sequence
  Synthetic
gugauacaaaaacagcaua

SEQ ID NO: 426 - RNA, 19 nt, Artificial Sequence
  Synthetic
ugauacaaaaacagcauau

SEQ ID NO: 427 - RNA, 19 nt, Artificial Sequence
  Synthetic
gauacaaaaacagcauaug

SEQ ID NO: 428 - RNA, 19 nt, Artificial Sequence
  Synthetic
auacaaaaacagcauaugu

SEQ ID NO: 429 - RNA, 19 nt, Artificial Sequence
  Synthetic
uacaaaaacagcauauguu

SEQ ID NO: 430 - RNA, 19 nt, Artificial Sequence
  Synthetic
gauugcaaugaucauaguu

SEQ ID NO: 431 - RNA, 19 nt, Artificial Sequence
  Synthetic
auugcaaugaucauaguuu

SEQ ID NO: 432 - RNA, 19 nt, Artificial Sequence
  Synthetic
uugcaaugaucauaguuua

SEQ ID NO: 433 - RNA, 19 nt, Artificial Sequence
  Synthetic
ugcaaugaucauaguuuac

SEQ ID NO: 434 - RNA, 19 nt, Artificial Sequence
  Synthetic
gcaaugaucauaguuuacc

SEQ ID NO: 435 - RNA, 19 nt, Artificial Sequence
  Synthetic
caaugaucauaguuuaccu

SEQ ID NO: 436 - RNA, 19 nt, Artificial Sequence
  Synthetic
aaugaucauaguuuaccua

SEQ ID NO: 437 - RNA, 19 nt, Artificial Sequence
  Synthetic
augaucauaguuuaccuau

SEQ ID NO: 438 - RNA, 19 nt, Artificial Sequence
  Synthetic
ugaucauaguuuaccuauu

SEQ ID NO: 439 - RNA, 19 nt, Artificial Sequence
  Synthetic
gaucauaguuuaccuauug

SEQ ID NO: 440 - RNA, 19 nt, Artificial Sequence
  Synthetic
aucauaguuuaccuauuga

SEQ ID NO: 441 - RNA, 19 nt, Artificial Sequence
  Synthetic
cugucauccagcaaauaca

SEQ ID NO: 442 - RNA, 19 nt, Artificial Sequence
  Synthetic
ugucauccagcaaauacac

SEQ ID NO: 443 - RNA, 19 nt, Artificial Sequence
  Synthetic
uucuggcaaugauaaucuc

SEQ ID NO: 444 - RNA, 19 nt, Artificial Sequence
  Synthetic
ucuggcaaugauaaucuca

SEQ ID NO: 445 - RNA, 19 nt, Artificial Sequence
  Synthetic
cuggcaaugauaaucucaa

SEQ ID NO: 446 - RNA, 19 nt, Artificial Sequence
  Synthetic
caugcucaagcagauuauu

SEQ ID NO: 447 - RNA, 19 nt, Artificial Sequence
  Synthetic
augcucaagcagauuauuu

SEQ ID NO: 448 - RNA, 19 nt, Artificial Sequence
  Synthetic
ugcucaagcagauuauuug

SEQ ID NO: 449 - RNA, 19 nt, Artificial Sequence
  Synthetic
aaaucaugcauuauguaac

SEQ ID NO: 450 - RNA, 19 nt, Artificial Sequence
  Synthetic
aaucaugcauuauguaaca

SEQ ID NO: 451 - RNA, 19 nt, Artificial Sequence
  Synthetic
aucaugcauuauguaacaa

SEQ ID NO: 452 - RNA, 19 nt, Artificial Sequence
  Synthetic
ucaugcauuauguaacaau

SEQ ID NO: 453 - RNA, 19 nt, Artificial Sequence
  Synthetic
caugcauuauguaacaaua

SEQ ID NO: 454 - RNA, 19 nt, Artificial Sequence
  Synthetic
augcauuauguaacaauaa

SEQ ID NO: 455 - RNA, 19 nt, Artificial Sequence
  Synthetic
acaaugaucuaucacuuga

SEQ ID NO: 456 - RNA, 19 nt, Artificial Sequence
  Synthetic
auaaagaguaugcaggcau

SEQ ID NO: 457 - RNA, 19 nt, Artificial Sequence
  Synthetic
auauuaugcaaaauauaga

SEQ ID NO: 458 - RNA, 19 nt, Artificial Sequence
  Synthetic
aacacaaauucaaugauga

SEQ ID NO: 459 - RNA, 19 nt, Artificial Sequence
  Synthetic
aauuugauaaguaccacuu

SEQ ID NO: 460 - RNA, 19 nt, Artificial Sequence
  Synthetic
uaaauuuaacucccuuggu

SEQ ID NO: 461 - RNA, 19 nt, Artificial Sequence
  Synthetic
uuagagaugggcagcaauu

SEQ ID NO: 462 - RNA, 19 nt, Artificial Sequence
  Synthetic
guuagauuacaaaauuugu

SEQ ID NO: 463 - RNA, 19 nt, Artificial Sequence
  Synthetic
uuugacaaugaugaaguag

SEQ ID NO: 464 - RNA, 19 nt, Artificial Sequence
  Synthetic
uuggcuaaggcagugauac

SEQ ID NO: 465 - RNA, 19 nt, Artificial Sequence
  Synthetic
cauacaaucaaauugaaug

SEQ ID NO: 466 - RNA, 19 nt, Artificial Sequence
  Synthetic
guuauuacaaguagugaua

SEQ ID NO: 467 - RNA, 19 nt, Artificial Sequence
  Synthetic
auaugggaaaugauggaau

SEQ ID NO: 468 - RNA, 19 nt, Artificial Sequence
  Synthetic
gacaauugugaaauuaaau

SEQ ID NO: 469 - RNA, 19 nt, Artificial Sequence
  Synthetic
uucuccaaaaaacuaagug

SEQ ID NO: 470 - RNA, 19 nt, Artificial Sequence
  Synthetic
gauucaacaaugaccaauu

SEQ ID NO: 471 - RNA, 19 nt, Artificial Sequence
  Synthetic
uauaugaaucaauuaucug

SEQ ID NO: 472 - RNA, 19 nt, Artificial Sequence
  Synthetic
gaauuacuuggauuugauc

SEQ ID NO: 473 - RNA, 19 nt, Artificial Sequence
  Synthetic
cuuaauccauaaauuauaa

SEQ ID NO: 474 - RNA, 19 nt, Artificial Sequence
  Synthetic
auuaguuaauauaaaacuu

SEQ ID NO: 475 - RNA, 19 nt, Artificial Sequence
  Synthetic
aaaacuugaugaaagacag

SEQ ID NO: 476 - RNA, 19 nt, Artificial Sequence
  Synthetic
ggccacauuuacauuccug

SEQ ID NO: 477 - RNA, 19 nt, Artificial Sequence
  Synthetic
ggucaacuaugaaaugaaa

SEQ ID NO: 478 - RNA, 19 nt, Artificial Sequence
  Synthetic
auauacugaauacaacaca

SEQ ID NO: 479 - RNA, 19 nt, Artificial Sequence
  Synthetic
ucaugauggguucuuagaa

SEQ ID NO: 480 - RNA, 19 nt, Artificial Sequence
  Synthetic
augcauuggcauuaagccu

SEQ ID NO: 481 - RNA, 19 nt, Artificial Sequence
  Synthetic
aauauacaaguaugaucuc

SEQ ID NO: 482 - RNA, 19 nt, Artificial Sequence
  Synthetic
gucaaguugaaugauacac

SEQ ID NO: 483 - RNA, 19 nt, Artificial Sequence
  Synthetic
cucaacaaagaucaacuuc

SEQ ID NO: 484 - RNA, 19 nt, Artificial Sequence
  Synthetic
accauccaacggagcacag

SEQ ID NO: 485 - RNA, 19 nt, Artificial Sequence
  Synthetic
ggagauaguauugauacuc

SEQ ID NO: 486 - RNA, 19 nt, Artificial Sequence
  Synthetic
ccuaauuaugaugugcaga

SEQ ID NO: 487 - RNA, 19 nt, Artificial Sequence
  Synthetic
aaacacaucaauaaguuau

SEQ ID NO: 488 - RNA, 19 nt, Artificial Sequence
  Synthetic
uguggcauguuauuaauca

SEQ ID NO: 489 - RNA, 19 nt, Artificial Sequence
  Synthetic
acagaagaugcuaaucaua

SEQ ID NO: 490 - RNA, 19 nt, Artificial Sequence
  Synthetic
aaauucacuggguuaauag

SEQ ID NO: 491 - RNA, 19 nt, Artificial Sequence
  Synthetic
gguauguuauaugcuaugu

SEQ ID NO: 492 - RNA, 19 nt, Artificial Sequence
  Synthetic
gacaccauaaaaauacuca

SEQ ID NO: 493 - RNA, 19 nt, Artificial Sequence
  Synthetic
agagaugcgggauaucaug

SEQ ID NO: 494 - RNA, 19 nt, Artificial Sequence
  Synthetic
gauguaacaacacaucguc

SEQ ID NO: 495 - RNA, 19 nt, Artificial Sequence
  Synthetic
gaaaugaaauuugaagugu

SEQ ID NO: 496 - RNA, 19 nt, Artificial Sequence
  Synthetic
acaacugaaauucaaauca

SEQ ID NO: 497 - RNA, 19 nt, Artificial Sequence
  Synthetic
aacauugagauagaaucua

SEQ ID NO: 498 - RNA, 19 nt, Artificial Sequence
  Synthetic
augcuaaaagaaaugggag

SEQ ID NO: 499 - RNA, 19 nt, Artificial Sequence
  Synthetic
gagguagcuccagaauaca

SEQ ID NO: 500 - RNA, 19 nt, Artificial Sequence
  Synthetic
ugugggaugauaauauuau

SEQ ID NO: 501 - RNA, 19 nt, Artificial Sequence
  Synthetic
gcuaauaauguccuaaaaa

SEQ ID NO: 502 - RNA, 19 nt, Artificial Sequence
  Synthetic
aaaggcuuacuacccaagg

SEQ ID NO: 503 - RNA, 19 nt, Artificial Sequence
  Synthetic
guuuuuguucauuuuggua

SEQ ID NO: 504 - RNA, 19 nt, Artificial Sequence
  Synthetic
agagguggcaguagaguug

SEQ ID NO: 505 - RNA, 19 nt, Artificial Sequence
  Synthetic
agugugcaagcagaaaugg

SEQ ID NO: 506 - RNA, 19 nt, Artificial Sequence
  Synthetic
uaugaauaugcccaaaaau

SEQ ID NO: 507 - RNA, 19 nt, Artificial Sequence
  Synthetic
aacccaaaagcaucauuau

SEQ ID NO: 508 - RNA, 19 nt, Artificial Sequence
  Synthetic
guauuaggcaaugcugcug

SEQ ID NO: 509 - RNA, 19 nt, Artificial Sequence
  Synthetic
ggccuaggcauaaugggag

SEQ ID NO: 510 - RNA, 19 nt, Artificial Sequence
  Synthetic
aggaaucaagaucuauaug

SEQ ID NO: 511 - RNA, 19 nt, Artificial Sequence
  Synthetic
gcugaacaacucaaagaaa

SEQ ID NO: 512 - RNA, 19 nt, Artificial Sequence
  Synthetic
aauggugugauuaacuaca

SEQ ID NO: 513 - RNA, 19 nt, Artificial Sequence
  Synthetic
gcagaagaacuagaggcua

SEQ ID NO: 514 - RNA, 19 nt, Artificial Sequence
  Synthetic
aucaaacaucagcuuaauc

SEQ ID NO: 515 - RNA, 19 nt, Artificial Sequence
  Synthetic
ccaaaagauaaugauguag

SEQ ID NO: 516 - RNA, 19 nt, Artificial Sequence
  Synthetic
gagcuuugaguuaauaaaa

SEQ ID NO: 517 - RNA, 19 nt, Artificial Sequence
  Synthetic
cuccugaauuccauggaga

SEQ ID NO: 518 - RNA, 19 nt, Artificial Sequence
  Synthetic
caauaaagggcaaauucac

SEQ ID NO: 519 - RNA, 19 nt, Artificial Sequence
  Synthetic
agaaaaaagauaguaucau

SEQ ID NO: 520 - RNA, 19 nt, Artificial Sequence
  Synthetic
uaucugucaacucaauaga

SEQ ID NO: 521 - RNA, 19 nt, Artificial Sequence
  Synthetic
aaagcccuauaacaucaaa

SEQ ID NO: 522 - RNA, 19 nt, Artificial Sequence
  Synthetic
caacaaaugagacagauga

SEQ ID NO: 523 - RNA, 19 nt, Artificial Sequence
  Synthetic
ccaauuaucaaagaaaacc

SEQ ID NO: 524 - RNA, 19 nt, Artificial Sequence
  Synthetic
cucuaguaaguuucaaaga

SEQ ID NO: 525 - RNA, 19 nt, Artificial Sequence
  Synthetic
uauacaaagaaaccauaga

SEQ ID NO: 526 - RNA, 19 nt, Artificial Sequence
  Synthetic
ggauugaugaaaaauuaag

SEQ ID NO: 527 - RNA, 19 nt, Artificial Sequence
  Synthetic
gugaaauacuaggaaugcu

SEQ ID NO: 528 - RNA, 19 nt, Artificial Sequence
  Synthetic
gagaugccaugguugguuu

SEQ ID NO: 529 - RNA, 19 nt, Artificial Sequence
  Synthetic
aaaaaaucagaacugaagc

SEQ ID NO: 530 - RNA, 19 nt, Artificial Sequence
  Synthetic
cauuaaugaccaaugacag

SEQ ID NO: 531 - RNA, 19 nt, Artificial Sequence
  Synthetic
gacucaggaaugaggaaag

SEQ ID NO: 532 - RNA, 19 nt, Artificial Sequence
  Synthetic
gugaaaagauggcaaaaga

SEQ ID NO: 533 - RNA, 19 nt, Artificial Sequence
  Synthetic
acacaucagaugaaguguc

SEQ ID NO: 534 - RNA, 19 nt, Artificial Sequence
  Synthetic
cucucaauccaacaucaga

SEQ ID NO: 535 - RNA, 19 nt, Artificial Sequence
  Synthetic
uggaagggaaugauaguga

SEQ ID NO: 536 - RNA, 19 nt, Artificial Sequence
  Synthetic
cugcuguucaauacaaugu

SEQ ID NO: 537 - RNA, 19 nt, Artificial Sequence
  Synthetic
acccugcaucacuuacaau

SEQ ID NO: 538 - RNA, 19 nt, Artificial Sequence
  Synthetic
uaugggugcccauguucca

SEQ ID NO: 539 - RNA, 19 nt, Artificial Sequence
  Synthetic
auuuacuuauaaaagaacu

SEQ ID NO: 540 - RNA, 19 nt, Artificial Sequence
  Synthetic
uagcuaaugucaacauacu

SEQ ID NO: 541 - RNA, 19 nt, Artificial Sequence
  Synthetic
uagugaaacaaauauccac

SEQ ID NO: 542 - RNA, 19 nt, Artificial Sequence
  Synthetic
uaagagucaugauaaacuc

SEQ ID NO: 543 - RNA, 19 nt, Artificial Sequence
  Synthetic
cacaaaugcccagcaaauu

SEQ ID NO: 544 - RNA, 19 nt, Artificial Sequence
  Synthetic
uguccuuggaugaaagaag

SEQ ID NO: 545 - RNA, 19 nt, Artificial Sequence
  Synthetic
uaaccacacccugugaaau

SEQ ID NO: 546 - RNA, 19 nt, Artificial Sequence
  Synthetic
ucaaggcauguagucuaac

SEQ ID NO: 547 - RNA, 19 nt, Artificial Sequence
  Synthetic
caugccuaaaaucaaaaaa

SEQ ID NO: 548 - RNA, 19 nt, Artificial Sequence
  Synthetic
caucaaaaaaagucauaau

SEQ ID NO: 549 - RNA, 19 nt, Artificial Sequence
  Synthetic
uaccaacauaccuaagauc

SEQ ID NO: 550 - RNA, 19 nt, Artificial Sequence
  Synthetic
ccaucagugucagaaauaa

SEQ ID NO: 551 - RNA, 19 nt, Artificial Sequence
  Synthetic
aagaucugaacacacuuga

SEQ ID NO: 552 - RNA, 19 nt, Artificial Sequence
  Synthetic
aaaauauaacaaccacuga

SEQ ID NO: 553 - RNA, 19 nt, Artificial Sequence
  Synthetic
caaaugcaaaaaucauccc

SEQ ID NO: 554 - RNA, 19 nt, Artificial Sequence
  Synthetic
uagucaucacagugacuga

SEQ ID NO: 555 - RNA, 19 nt, Artificial Sequence
  Synthetic
acaacaaaggagcauucaa

SEQ ID NO: 556 - RNA, 19 nt, Artificial Sequence
  Synthetic
uuggagcuuaccuagaaaa

SEQ ID NO: 557 - RNA, 19 nt, Artificial Sequence
  Synthetic
aagaaaguauauauuaugu

SEQ ID NO: 558 - RNA, 19 nt, Artificial Sequence
  Synthetic
acacagcuacacgauuugc

SEQ ID NO: 559 - RNA, 19 nt, Artificial Sequence
  Synthetic
caaucaaacccauggaaga

SEQ ID NO: 560 - RNA, 19 nt, Artificial Sequence
  Synthetic
uacaaacuuucuaccuaca

SEQ ID NO: 561 - RNA, 19 nt, Artificial Sequence
  Synthetic
cagaucaucccaagucauu

SEQ ID NO: 562 - RNA, 19 nt, Artificial Sequence
  Synthetic
ccaacuaaucacaauaucu

SEQ ID NO: 563 - RNA, 19 nt, Artificial Sequence
  Synthetic
aaccaauggaaaauacauc

SEQ ID NO: 564 - RNA, 19 nt, Artificial Sequence
  Synthetic
ccauaacaauagaauucuc

SEQ ID NO: 565 - RNA, 19 nt, Artificial Sequence
  Synthetic
caagcaaauucuggccuua

SEQ ID NO: 566 - RNA, 19 nt, Artificial Sequence
  Synthetic
acuuuacacuaauacacau

SEQ ID NO: 567 - RNA, 19 nt, Artificial Sequence
  Synthetic
cuuugcuaaucauaaucuc

SEQ ID NO: 568 - RNA, 19 nt, Artificial Sequence
  Synthetic
auaacguauuccauaacaa

SEQ ID NO: 569 - RNA, 19 nt, Artificial Sequence
  Synthetic
gcaaaugcaaacaugucca

SEQ ID NO: 570 - RNA, 19 nt, Artificial Sequence
  Synthetic
aaaaacaaggaccaacgca

SEQ ID NO: 571 - RNA, 19 nt, Artificial Sequence
  Synthetic
gcacaaaucacauuaucca

SEQ ID NO: 572 - RNA, 19 nt, Artificial Sequence
  Synthetic
auucuggcaaugauaaucu

SEQ ID NO: 573 - RNA, 19 nt, Artificial Sequence
  Synthetic
gccucggcaaaccacaaag

SEQ ID NO: 574 - RNA, 19 nt, Artificial Sequence
  Synthetic
aucauacaagaugcaacaa

SEQ ID NO: 575 - RNA, 19 nt, Artificial Sequence
  Synthetic
agccagaucaagaacacaa

SEQ ID NO: 576 - RNA, 19 nt, Artificial Sequence
  Synthetic
cccaauaaugauuuucacu

SEQ ID NO: 577 - RNA, 19 nt, Artificial Sequence
  Synthetic
agcaacaauccaaccugcu

SEQ ID NO: 578 - RNA, 19 nt, Artificial Sequence
  Synthetic
aacaccaccaaaacaaaca

SEQ ID NO: 579 - RNA, 19 nt, Artificial Sequence
  Synthetic
ggggcaaauaacaauggag

SEQ ID NO: 580 - RNA, 19 nt, Artificial Sequence
  Synthetic
aaacaucacugaagaauuu

SEQ ID NO: 581 - RNA, 19 nt, Artificial Sequence
  Synthetic
uauaacuauagaauuaagu

SEQ ID NO: 582 - RNA, 19 nt, Artificial Sequence
  Synthetic
auugcaguugcucaugcaa

SEQ ID NO: 583 - RNA, 19 nt, Artificial Sequence
  Synthetic
caaucgagccagaagagaa

SEQ ID NO: 584 - RNA, 19 nt, Artificial Sequence
  Synthetic
acuaccaagguuuaugaau

SEQ ID NO: 585 - RNA, 19 nt, Artificial Sequence
  Synthetic
auuaagcaagaaaaggaaa

SEQ ID NO: 586 - RNA, 19 nt, Artificial Sequence
  Synthetic
uuuguuagguguuggaucu

SEQ ID NO: 587 - RNA, 19 nt, Artificial Sequence
  Synthetic
ugcuguaucuaagguccug

SEQ ID NO: 588 - RNA, 19 nt, Artificial Sequence
  Synthetic
ucuacuauccacaaacaag

SEQ ID NO: 589 - RNA, 19 nt, Artificial Sequence
  Synthetic
aaccagcaaaguguuagac

SEQ ID NO: 590 - RNA, 19 nt, Artificial Sequence
  Synthetic
ccucaaaaacuauauagau

SEQ ID NO: 591 - RNA, 19 nt, Artificial Sequence
  Synthetic
acaaaagaacaacagacua

SEQ ID NO: 592 - RNA, 19 nt, Artificial Sequence
  Synthetic
acuagagauuaccagggaa

SEQ ID NO: 593 - RNA, 19 nt, Artificial Sequence
  Synthetic
aaucaaugauaugccuaua

SEQ ID NO: 594 - RNA, 19 nt, Artificial Sequence
  Synthetic
aacaaaugaucagaaaaag

SEQ ID NO: 595 - RNA, 19 nt, Artificial Sequence
  Synthetic
guuaauguccaacaauguu

SEQ ID NO: 596 - RNA, 19 nt, Artificial Sequence
  Synthetic
ucaaauaguuagacagcaa

SEQ ID NO: 597 - RNA, 19 nt, Artificial Sequence
  Synthetic
aaguuacucuaucaugucc

SEQ ID NO: 598 - RNA, 19 nt, Artificial Sequence
  Synthetic
cuuagcauauguaguacaa

SEQ ID NO: 599 - RNA, 19 nt, Artificial Sequence
  Synthetic
ucuauguacaaccaacaca

SEQ ID NO: 600 - RNA, 19 nt, Artificial Sequence
  Synthetic
cagaggaugguacugugac

SEQ ID NO: 601 - RNA, 19 nt, Artificial Sequence
  Synthetic
caaugcaggaucaguaucu

SEQ ID NO: 602 - RNA, 19 nt, Artificial Sequence
  Synthetic
cacaaugaacaguuuaaca

SEQ ID NO: 603 - RNA, 19 nt, Artificial Sequence
  Synthetic
auuaccaagugaaguaaau

SEQ ID NO: 604 - RNA, 19 nt, Artificial Sequence
  Synthetic
aaaaacagauguaagcagc

SEQ ID NO: 605 - RNA, 19 nt, Artificial Sequence
  Synthetic
cuccguuaucacaucucua

SEQ ID NO: 606 - RNA, 19 nt, Artificial Sequence
  Synthetic
aggagccauugugucaugc

SEQ ID NO: 607 - RNA, 19 nt, Artificial Sequence
  Synthetic
cuauggcaaaacuaaaugu

SEQ ID NO: 608 - RNA, 19 nt, Artificial Sequence
  Synthetic
uacagcauccaauaaaaau

SEQ ID NO: 609 - RNA, 19 nt, Artificial Sequence
  Synthetic
ucguggaaucauaaagaca

SEQ ID NO: 610 - RNA, 19 nt, Artificial Sequence
  Synthetic
aggugaaccaauaauaaau

SEQ ID NO: 611 - RNA, 19 nt, Artificial Sequence
  Synthetic
ucguaaauccgaugaauua

SEQ ID NO: 612 - RNA, 19 nt, Artificial Sequence
  Synthetic
uaucaugauaacuacuaua

SEQ ID NO: 613 - RNA, 19 nt, Artificial Sequence
  Synthetic
aauuauagugauuauagua

SEQ ID NO: 614 - RNA, 19 nt, Artificial Sequence
  Synthetic
aauauuguuaucauuaauu

SEQ ID NO: 615 - RNA, 19 nt, Artificial Sequence
  Synthetic
cacaccagucacacuaagc

SEQ ID NO: 616 - RNA, 19 nt, Artificial Sequence
  Synthetic
uauaaauaauauugcauuu

SEQ ID NO: 617 - RNA, 19 nt, Artificial Sequence
  Synthetic
agcaccuaaucauguucuu

SEQ ID NO: 618 - RNA, 19 nt, Artificial Sequence
  Synthetic
gcucauagacaacccaucu

SEQ ID NO: 619 - RNA, 19 nt, Artificial Sequence
  Synthetic
aaaucugaacuucaucgaa

SEQ ID NO: 620 - RNA, 19 nt, Artificial Sequence
  Synthetic
aaguagauuccuaguuuau

SEQ ID NO: 621 - RNA, 19 nt, Artificial Sequence
  Synthetic
acgaaggaauccuugcaaa

SEQ ID NO: 622 - RNA, 19 nt, Artificial Sequence
  Synthetic
auuugaaauucgaggucau

SEQ ID NO: 623 - RNA, 19 nt, Artificial Sequence
  Synthetic
uuauuuugaauggccaccc

SEQ ID NO: 624 - RNA, 19 nt, Artificial Sequence
  Synthetic
acaaaacuuuauguuaaac

SEQ ID NO: 625 - RNA, 19 nt, Artificial Sequence
  Synthetic
cagaauacuuaagucuaug

SEQ ID NO: 626 - RNA, 19 nt, Artificial Sequence
  Synthetic
agcugcagaguuggacaga

SEQ ID NO: 627 - RNA, 19 nt, Artificial Sequence
  Synthetic
acaaucagcauguguugcc

SEQ ID NO: 628 - RNA, 19 nt, Artificial Sequence
  Synthetic
caugagcaaacuccucacu

SEQ ID NO: 629 - RNA, 19 nt, Artificial Sequence
  Synthetic
acccaagauaagaguguac

SEQ ID NO: 630 - RNA, 19 nt, Artificial Sequence
  Synthetic
caauacugucauaucauau

SEQ ID NO: 631 - RNA, 19 nt, Artificial Sequence
  Synthetic
uauugaaagcaacaggaaa

SEQ ID NO: 632 - RNA, 19 nt, Artificial Sequence
  Synthetic
aaacaauaaacaaacuauc

SEQ ID NO: 633 - RNA, 19 nt, Artificial Sequence
  Synthetic
ccaucuguuaaaaagauug

SEQ ID NO: 634 - RNA, 19 nt, Artificial Sequence
  Synthetic
gccagcagacguauugaag

SEQ ID NO: 635 - RNA, 19 nt, Artificial Sequence
  Synthetic
caaaaauaaugauacuacc

SEQ ID NO: 636 - RNA, 19 nt, Artificial Sequence
  Synthetic
cugacaaauauccuuguag

SEQ ID NO: 637 - RNA, 19 nt, Artificial Sequence
  Synthetic
agaacacacuauauuucaa

SEQ ID NO: 638 - RNA, 19 nt, Artificial Sequence
  Synthetic
uagugucauaacacucaau

SEQ ID NO: 639 - RNA, 19 nt, Artificial Sequence
  Synthetic
uuaauggaaauucugcuaa

SEQ ID NO: 640 - RNA, 19 nt, Artificial Sequence
  Synthetic
augcuuuaggaaguuacau

SEQ ID NO: 641 - RNA, 19 nt, Artificial Sequence
  Synthetic
uauucaaugguccuuaucu

SEQ ID NO: 642 - RNA, 19 nt, Artificial Sequence
  Synthetic
ucaaaaaugauuauaccaa

SEQ ID NO: 643 - RNA, 19 nt, Artificial Sequence
  Synthetic
acuuaauuaguagacaaaa

SEQ ID NO: 644 - RNA, 19 nt, Artificial Sequence
  Synthetic
auccauuaauagaacacau

SEQ ID NO: 645 - RNA, 19 nt, Artificial Sequence
  Synthetic
auauaacacaguccuuaau

SEQ ID NO: 646 - RNA, 19 nt, Artificial Sequence
  Synthetic
cauuacuuaugacauacaa

SEQ ID NO: 647 - RNA, 19 nt, Artificial Sequence
  Synthetic
auuuacuuaaaaagauaau

SEQ ID NO: 648 - RNA, 19 nt, Artificial Sequence
  Synthetic
uaagaagagcuauagaaau

SEQ ID NO: 649 - RNA, 19 nt, Artificial Sequence
  Synthetic
augcuauauugaauaaacu

SEQ ID NO: 650 - RNA, 19 nt, Artificial Sequence
  Synthetic
acaagauuaaauccaacaa

SEQ ID NO: 651 - RNA, 19 nt, Artificial Sequence
  Synthetic
uaaucaaagaugauauacu

SEQ ID NO: 652 - RNA, 19 nt, Artificial Sequence
  Synthetic
aucaaucucaucuuaaagc

SEQ ID NO: 653 - RNA, 19 nt, Artificial Sequence
  Synthetic
gguuaauacauugguuuaa

SEQ ID NO: 654 - RNA, 19 nt, Artificial Sequence
  Synthetic
acaacauauuaacacagua

SEQ ID NO: 655 - RNA, 19 nt, Artificial Sequence
  Synthetic
guauaguuuaucauaagga

SEQ ID NO: 656 - RNA, 19 nt, Artificial Sequence
  Synthetic
aacucaaaagaauuacugu

SEQ ID NO: 657 - RNA, 19 nt, Artificial Sequence
  Synthetic
ugacaaccuauaaucaauu

SEQ ID NO: 658 - RNA, 19 nt, Artificial Sequence
  Synthetic
uuagccuuaguagauuaaa

SEQ ID NO: 659 - RNA, 19 nt, Artificial Sequence
  Synthetic
auguuuguuuaauuacaug

SEQ ID NO: 660 - RNA, 19 nt, Artificial Sequence
  Synthetic
acacauuaaauaaaagcuu

SEQ ID NO: 661 - RNA, 19 nt, Artificial Sequence
  Synthetic
ucaauaauguuaucuugac

SEQ ID NO: 662 - RNA, 19 nt, Artificial Sequence
  Synthetic
ucuacauaauaaaagaggu

SEQ ID NO: 663 - RNA, 19 nt, Artificial Sequence
  Synthetic
cucuaauuuuaaauauaac

SEQ ID NO: 664 - RNA, 19 nt, Artificial Sequence
  Synthetic
cagaagaagaucaauucag

SEQ ID NO: 665 - RNA, 19 nt, Artificial Sequence
  Synthetic
guaugcucaacaacaucac

SEQ ID NO: 666 - RNA, 19 nt, Artificial Sequence
  Synthetic
cagaugcugcuaauaaagc

SEQ ID NO: 667 - RNA, 19 nt, Artificial Sequence
  Synthetic
caagaguaugucauacauu

SEQ ID NO: 668 - RNA, 19 nt, Artificial Sequence
  Synthetic
ccgauaauauaauaaaugg

SEQ ID NO: 669 - RNA, 19 nt, Artificial Sequence
  Synthetic
gcagauggauaauucuauu

SEQ ID NO: 670 - RNA, 19 nt, Artificial Sequence
  Synthetic
uaaguaaguuccuuaaauu

SEQ ID NO: 671 - RNA, 19 nt, Artificial Sequence
  Synthetic
uaauuaagcuugcagguga

SEQ ID NO: 672 - RNA, 19 nt, Artificial Sequence
  Synthetic
acaauaaccuuaacaaucu

SEQ ID NO: 673 - RNA, 19 nt, Artificial Sequence
  Synthetic
uguucagaauauuuggaca

SEQ ID NO: 674 - RNA, 19 nt, Artificial Sequence
  Synthetic
acccaaugguagaugaaag

SEQ ID NO: 675 - RNA, 19 nt, Artificial Sequence
  Synthetic
gacaagccauggaugcugu

SEQ ID NO: 676 - RNA, 19 nt, Artificial Sequence
  Synthetic
agaccaaauuuuacuuguu

SEQ ID NO: 677 - RNA, 19 nt, Artificial Sequence
  Synthetic
uaagaggugccuuuauaua

SEQ ID NO: 678 - RNA, 19 nt, Artificial Sequence
  Synthetic
uuguaaauaauuacaacag

SEQ ID NO: 679 - RNA, 19 nt, Artificial Sequence
  Synthetic
augcuauuguuuuacccuu

SEQ ID NO: 680 - RNA, 19 nt, Artificial Sequence
  Synthetic
uaagaugguuaacuuacua

SEQ ID NO: 681 - RNA, 19 nt, Artificial Sequence
  Synthetic
auaaacuaaacacuuaucc

SEQ ID NO: 682 - RNA, 19 nt, Artificial Sequence
  Synthetic
cagaaagagauuugauugu

SEQ ID NO: 683 - RNA, 19 nt, Artificial Sequence
  Synthetic
ucuaucgugaguuucgguu

SEQ ID NO: 684 - RNA, 19 nt, Artificial Sequence
  Synthetic
cuaaaaauuugauauggac

SEQ ID NO: 685 - RNA, 19 nt, Artificial Sequence
  Synthetic
cuaguuucccuagaaauua

SEQ ID NO: 686 - RNA, 19 nt, Artificial Sequence
  Synthetic
aaaaauuaaaauuuuccga

SEQ ID NO: 687 - RNA, 19 nt, Artificial Sequence
  Synthetic
agagugauaaaucaagaag

SEQ ID NO: 688 - RNA, 19 nt, Artificial Sequence
  Synthetic
uaagagauaacaaauucaa

SEQ ID NO: 689 - RNA, 19 nt, Artificial Sequence
  Synthetic
augaaugugauuuauacaa

SEQ ID NO: 690 - RNA, 19 nt, Artificial Sequence
  Synthetic
acuguguaguuaaucaaag

SEQ ID NO: 691 - RNA, 19 nt, Artificial Sequence
  Synthetic
caggcaaagaaagagaacu

SEQ ID NO: 692 - RNA, 19 nt, Artificial Sequence
  Synthetic
uagcugaaaacauuuuaca

SEQ ID NO: 693 - RNA, 19 nt, Artificial Sequence
  Synthetic
aauucuuuccugaaagucu

SEQ ID NO: 694 - RNA, 19 nt, Artificial Sequence
  Synthetic
uuacaagauauggugaucu

SEQ ID NO: 695 - RNA, 19 nt, Artificial Sequence
  Synthetic
uaaguaacaaaucaaaucg

SEQ ID NO: 696 - RNA, 19 nt, Artificial Sequence
  Synthetic
acaauuacauuaguaagug

SEQ ID NO: 697 - RNA, 19 nt, Artificial Sequence
  Synthetic
gcucuaucaucacagaucu

SEQ ID NO: 698 - RNA, 19 nt, Artificial Sequence
  Synthetic
ucagcaaauucaaucaagc

SEQ ID NO: 699 - RNA, 19 nt, Artificial Sequence
  Synthetic
cauguauuuguagugaugu

SEQ ID NO: 700 - RNA, 19 nt, Artificial Sequence
  Synthetic
uuccucaugucacaauaau

SEQ ID NO: 701 - RNA, 19 nt, Artificial Sequence
  Synthetic
uaugcacauauaggcaugc

SEQ ID NO: 702 - RNA, 19 nt, Artificial Sequence
  Synthetic
aucauauuguagaucuuaa

SEQ ID NO: 703 - RNA, 19 nt, Artificial Sequence
  Synthetic
acaauguagaugaacaaag

SEQ ID NO: 704 - RNA, 19 nt, Artificial Sequence
  Synthetic
guggauuauauagauauca

SEQ ID NO: 705 - RNA, 19 nt, Artificial Sequence
  Synthetic
gguggugucaaaaacuaug

SEQ ID NO: 706 - RNA, 19 nt, Artificial Sequence
  Synthetic
ggaccauagaagcuauauc

SEQ ID NO: 707 - RNA, 19 nt, Artificial Sequence
  Synthetic
cacuauuggaucuaauauc

SEQ ID NO: 708 - RNA, 19 nt, Artificial Sequence
  Synthetic
caauuacugcuuuaauuaa

SEQ ID NO: 709 - RNA, 19 nt, Artificial Sequence
  Synthetic
auggugacaaucaaucaau

SEQ ID NO: 710 - RNA, 19 nt, Artificial Sequence
  Synthetic
ucagacucauggaagguca

SEQ ID NO: 711 - RNA, 19 nt, Artificial Sequence
  Synthetic
auuauuugcuagcauuaaa

SEQ ID NO: 712 - RNA, 19 nt, Artificial Sequence
  Synthetic
gaacugagacuuauauauc

SEQ ID NO: 713 - RNA, 19 nt, Artificial Sequence
  Synthetic
ugaguaaaacaauucaaca

SEQ ID NO: 714 - RNA, 19 nt, Artificial Sequence
  Synthetic
auaacgguguauauuaccc

SEQ ID NO: 715 - RNA, 19 nt, Artificial Sequence
  Synthetic
uccuaagagugggaccgug

SEQ ID NO: 716 - RNA, 19 nt, Artificial Sequence
  Synthetic
ggauaaacacuauacuuga

SEQ ID NO: 717 - RNA, 19 nt, Artificial Sequence
  Synthetic
augauuucaaagugagucu

SEQ ID NO: 718 - RNA, 19 nt, Artificial Sequence
  Synthetic
uagaaucuauagguaguuu

SEQ ID NO: 719 - RNA, 19 nt, Artificial Sequence
  Synthetic
ugacacaagaauuagaaua

SEQ ID NO: 720 - RNA, 19 nt, Artificial Sequence
  Synthetic
gaaauguaugguuauauaa

SEQ ID NO: 721 - RNA, 19 nt, Artificial Sequence
  Synthetic
uggacauauuaaagguucu

SEQ ID NO: 722 - RNA, 19 nt, Artificial Sequence
  Synthetic
ugaaacacuuaaaaaccuu

SEQ ID NO: 723 - RNA, 19 nt, Artificial Sequence
  Synthetic
uuuuuaaucuugauaauau

SEQ ID NO: 724 - RNA, 19 nt, Artificial Sequence
  Synthetic
uugauacagcauuaacauu

SEQ ID NO: 725 - RNA, 19 nt, Artificial Sequence
  Synthetic
uguuauuugguggugguga

SEQ ID NO: 726 - RNA, 19 nt, Artificial Sequence
  Synthetic
aucccaacuuguuauaucg

SEQ ID NO: 727 - RNA, 19 nt, Artificial Sequence
  Synthetic
gaaguuucuauagaagaac

SEQ ID NO: 728 - RNA, 19 nt, Artificial Sequence
  Synthetic
aggcuauaguucacucugu

SEQ ID NO: 729 - RNA, 19 nt, Artificial Sequence
  Synthetic
uguucauacuuaguuauua

SEQ ID NO: 730 - RNA, 19 nt, Artificial Sequence
  Synthetic
ugucagaugauagauugaa

SEQ ID NO: 731 - RNA, 19 nt, Artificial Sequence
  Synthetic
auaaguucuuaacaugcau

SEQ ID NO: 732 - RNA, 19 nt, Artificial Sequence
  Synthetic
acccuaaugcugaauucgu

SEQ ID NO: 733 - RNA, 19 nt, Artificial Sequence
  Synthetic
uaacauugaugagagaucc

SEQ ID NO: 734 - RNA, 19 nt, Artificial Sequence
  Synthetic
cucaagcuuuagggucuga

SEQ ID NO: 735 - RNA, 19 nt, Artificial Sequence
  Synthetic
agagacaagcuaaaauuac

SEQ ID NO: 736 - RNA, 19 nt, Artificial Sequence
  Synthetic
aaauauucuccaaaagugc

SEQ ID NO: 737 - RNA, 19 nt, Artificial Sequence
  Synthetic
cagagauagaucuaaauga

SEQ ID NO: 738 - RNA, 19 nt, Artificial Sequence
  Synthetic
ggcuaagaguuguuuauga

SEQ ID NO: 739 - RNA, 19 nt, Artificial Sequence
  Synthetic
aaaguuuacccuuuuauaa

SEQ ID NO: 740 - RNA, 19 nt, Artificial Sequence
  Synthetic
aagcagagaaaauaguaaa

SEQ ID NO: 741 - RNA, 19 nt, Artificial Sequence
  Synthetic
aaucuauaacuaacauacu

SEQ ID NO: 742 - RNA, 19 nt, Artificial Sequence
  Synthetic
uagacuuaacagauauuga

SEQ ID NO: 743 - RNA, 19 nt, Artificial Sequence
  Synthetic
auagagccacugagaugau

SEQ ID NO: 744 - RNA, 19 nt, Artificial Sequence
  Synthetic
ugaggaaaaacauaacuuu

SEQ ID NO: 745 - RNA, 19 nt, Artificial Sequence
  Synthetic
guauggaaaaccuaaguau

SEQ ID NO: 746 - RNA, 19 nt, Artificial Sequence
  Synthetic
uuacugaauuaagcaaaua

SEQ ID NO: 747 - RNA, 19 nt, Artificial Sequence
  Synthetic
auguuagggaaagaucuug

SEQ ID NO: 748 - RNA, 19 nt, Artificial Sequence
  Synthetic
ggucuuuauccaauauagu

SEQ ID NO: 749 - RNA, 19 nt, Artificial Sequence
  Synthetic
guaucauguauacaaugga

SEQ ID NO: 750 - RNA, 19 nt, Artificial Sequence
  Synthetic
auguuaacaguuuaacacg

SEQ ID NO: 751 - RNA, 19 nt, Artificial Sequence
  Synthetic
cuaaaccauggguugguuc

SEQ ID NO: 752 - RNA, 19 nt, Artificial Sequence
  Synthetic
caucuacacaagagaaaaa

SEQ ID NO: 753 - RNA, 19 nt, Artificial Sequence
  Synthetic
aaacaaugccaguuuauaa

SEQ ID NO: 754 - RNA, 19 nt, Artificial Sequence
  Synthetic
auagacaaguuuuaaccaa

SEQ ID NO: 755 - RNA, 19 nt, Artificial Sequence
  Synthetic
uagaucuauuagcaaaauu

SEQ ID NO: 756 - RNA, 19 nt, Artificial Sequence
  Synthetic
uggauuggguguaugcauc

SEQ ID NO: 757 - RNA, 19 nt, Artificial Sequence
  Synthetic
cuauagauaacaaggauga

SEQ ID NO: 758 - RNA, 19 nt, Artificial Sequence
  Synthetic
ugcaucgccuuacagucag

SEQ ID NO: 759 - RNA, 19 nt, Artificial Sequence
  Synthetic
cuauuaaucgcauauuaac

SEQ ID NO: 760 - RNA, 19 nt, Artificial Sequence
  Synthetic
cagaaaaguauggugauga

SEQ ID NO: 761 - RNA, 19 nt, Artificial Sequence
  Synthetic
uccaaaacuguauaagcuu

SEQ ID NO: 762 - RNA, 19 nt, Artificial Sequence
  Synthetic
caguaguagaacaauuuac

SEQ ID NO: 763 - RNA, 19 nt, Artificial Sequence
  Synthetic
cuaauguauguccuaacag

SEQ ID NO: 764 - RNA, 19 nt, Artificial Sequence
  Synthetic
agcuuaaugagauacauuu

SEQ ID NO: 765 - RNA, 19 nt, Artificial Sequence
  Synthetic
ucacaggugauguugauau

SEQ ID NO: 766 - RNA, 19 nt, Artificial Sequence
  Synthetic
uucacaaguuaaaacaagu

SEQ ID NO: 767 - RNA, 19 nt, Artificial Sequence
  Synthetic
uguuuuuaccagacaaaau

SEQ ID NO: 768 - RNA, 19 nt, Artificial Sequence
  Synthetic
uaaguuugacucaauaugu

SEQ ID NO: 769 - RNA, 19 nt, Artificial Sequence
  Synthetic
uggaauuauucuuaaguaa

SEQ ID NO: 770 - RNA, 19 nt, Artificial Sequence
  Synthetic
gaucucauguuaauucuaa

SEQ ID NO: 771 - RNA, 19 nt, Artificial Sequence
  Synthetic
auaauacuuacauuuuaag

SEQ ID NO: 772 - RNA, 19 nt, Artificial Sequence
  Synthetic
aacuuaugaaagauucuaa

SEQ ID NO: 773 - RNA, 19 nt, Artificial Sequence
  Synthetic
auuggggagagggauauau

SEQ ID NO: 774 - RNA, 19 nt, Artificial Sequence
  Synthetic
uuaauuugaaaguuuucuu

SEQ ID NO: 775 - RNA, 19 nt, Artificial Sequence
  Synthetic
ucaaugcuuauaagaccua

SEQ ID NO: 776 - RNA, 19 nt, Artificial Sequence
  Synthetic
aucucuuguguuuucauaa

SEQ ID NO: 777 - RNA, 19 nt, Artificial Sequence
  Synthetic
guguauuggaauuaauaga

SEQ ID NO: 778 - RNA, 19 nt, Artificial Sequence
  Synthetic
acaguaguuauuggaaguc

SEQ ID NO: 779 - RNA, 19 nt, Artificial Sequence
  Synthetic
cuaugucuaagguauuuuu

SEQ ID NO: 780 - RNA, 19 nt, Artificial Sequence
  Synthetic
uagaacaaaaaguuaucaa

SEQ ID NO: 781 - RNA, 19 nt, Artificial Sequence
  Synthetic
augcaaguuuacauagagu

SEQ ID NO: 782 - RNA, 19 nt, Artificial Sequence
  Synthetic
uaaaaggaugucauagcuu

SEQ ID NO: 783 - RNA, 19 nt, Artificial Sequence
  Synthetic
aucauccaacacauaugaa

SEQ ID NO: 784 - RNA, 19 nt, Artificial Sequence
  Synthetic
aagcaauauuaacuuauau

SEQ ID NO: 785 - RNA, 19 nt, Artificial Sequence
  Synthetic
uagaucuuguuagaauggg

SEQ ID NO: 786 - RNA, 19 nt, Artificial Sequence
  Synthetic
aauuuuauacuucuaaucu

SEQ ID NO: 787 - RNA, 19 nt, Artificial Sequence
  Synthetic
acuucucagauaauacuca

SEQ ID NO: 788 - RNA, 19 nt, Artificial Sequence
  Synthetic
aauuagaaaauaauuacaa

SEQ ID NO: 789 - RNA, 19 nt, Artificial Sequence
  Synthetic
acaaauuauaucauccuac

SEQ ID NO: 790 - RNA, 19 nt, Artificial Sequence
  Synthetic
guauagguaaaaauguuga

SEQ ID NO: 791 - RNA, 19 nt, Artificial Sequence
  Synthetic
acucaauaauguuaccauu

SEQ ID NO: 792 - RNA, 19 nt, Artificial Sequence
  Synthetic
uguuaucuaauaagaagcu

SEQ ID NO: 793 - RNA, 19 nt, Artificial Sequence
  Synthetic
ugauuagaaccaauuacag

SEQ ID NO: 794 - RNA, 19 nt, Artificial Sequence
  Synthetic
auauuaauagauucaauuu

SEQ ID NO: 795 - RNA, 19 nt, Artificial Sequence
  Synthetic
uuguauuuaguucuacagg

SEQ ID NO: 796 - RNA, 19 nt, Artificial Sequence
  Synthetic
guuguaaaauuaguauaga

SEQ ID NO: 797 - RNA, 19 nt, Artificial Sequence
  Synthetic
auuguauagcauucauagg

SEQ ID NO: 798 - RNA, 19 nt, Artificial Sequence
  Synthetic
gugaaggagcagggaauuu

SEQ ID NO: 799 - RNA, 19 nt, Artificial Sequence
  Synthetic
uaagauauauuuacagaag

SEQ ID NO: 800 - RNA, 19 nt, Artificial Sequence
  Synthetic
auggacauaucaacauuga

SEQ ID NO: 801 - RNA, 19 nt, Artificial Sequence
  Synthetic
auuauggugaaaauuugac

SEQ ID NO: 802 - RNA, 19 nt, Artificial Sequence
  Synthetic
caaccaacaacauucauug

SEQ ID NO: 803 - RNA, 19 nt, Artificial Sequence
  Synthetic
aguuugcugaaccuaucag

SEQ ID NO: 804 - RNA, 19 nt, Artificial Sequence
  Synthetic
ucaacuggaguaaaauuau

SEQ ID NO: 805 - RNA, 19 nt, Artificial Sequence
  Synthetic
acuguuccucaguuaauaa

SEQ ID NO: 806 - RNA, 19 nt, Artificial Sequence
  Synthetic
acaauauaacuauauuaaa

SEQ ID NO: 807 - RNA, 19 nt, Artificial Sequence
  Synthetic
auguaguacaaaaugcuaa

SEQ ID NO: 808 - RNA, 19 nt, Artificial Sequence
  Synthetic
aauugauacuaucaagaac

SEQ ID NO: 809 - RNA, 19 nt, Artificial Sequence
  Synthetic
ccaaaaauuucaucaugcc

SEQ ID NO: 810 - RNA, 19 nt, Artificial Sequence
  Synthetic
agucuauugaugcaaauau

SEQ ID NO: 811 - RNA, 19 nt, Artificial Sequence
  Synthetic
uuaaaaguuugauacccuu

SEQ ID NO: 812 - RNA, 19 nt, Artificial Sequence
  Synthetic
uucuuuguuacccuauaac

SEQ ID NO: 813 - RNA, 19 nt, Artificial Sequence
  Synthetic
caaaaaaaggaauuaauac

SEQ ID NO: 814 - RNA, 19 nt, Artificial Sequence
  Synthetic
cugcauugucaaaacuaaa

SEQ ID NO: 815 - RNA, 19 nt, Artificial Sequence
  Synthetic
agaguguuguuaguggaga

SEQ ID NO: 816 - RNA, 19 nt, Artificial Sequence
  Synthetic
auauacuaucauauucuau

SEQ ID NO: 817 - RNA, 19 nt, Artificial Sequence
  Synthetic
uuuucagcaauaaacuuau

SEQ ID NO: 818 - RNA, 19 nt, Artificial Sequence
  Synthetic
uaaaucauaagcauaugaa

SEQ ID NO: 819 - RNA, 19 nt, Artificial Sequence
  Synthetic
aucauguuuuaaauuucag

SEQ ID NO: 820 - RNA, 19 nt, Artificial Sequence
  Synthetic
gaucaacagaacuaaacua

SEQ ID NO: 821 - RNA, 19 nt, Artificial Sequence
  Synthetic
uagaaucuacauauccuua

SEQ ID NO: 822 - RNA, 19 nt, Artificial Sequence
  Synthetic
aacuuaaaaaacugauuaa

SEQ ID NO: 823 - RNA, 19 nt, Artificial Sequence
  Synthetic
uauacaacuuucauaauga

SEQ ID NO: 824 - RNA, 19 nt, Artificial Sequence
  Synthetic
cgagauauuaguuuuugac

SEQ ID NO: 825 - RNA, 19 nt, Artificial Sequence
  Synthetic
gcgaaaaaaugcguacaac

SEQ ID NO: 826 - RNA, 19 nt, Artificial Sequence
  Synthetic
ucauugaguaugauaaaag

SEQ ID NO: 827 - RNA, 19 nt, Artificial Sequence
  Synthetic
auuugcccuaauaauaaua

SEQ ID NO: 828 - RNA, 19 nt, Artificial Sequence
  Synthetic
aucaaugucacuaacacca

SEQ ID NO: 829 - RNA, 19 nt, Artificial Sequence
  Synthetic
gggcaaauaaaucaauuca

SEQ ID NO: 830 - RNA, 19 nt, Artificial Sequence
  Synthetic
auuuauauacuugauaaau

SEQ ID NO: 831 - RNA, 19 nt, Artificial Sequence
  Synthetic
uuauaguaauuuaaaauua

SEQ ID NO: 832 - RNA, 19 nt, Artificial Sequence
  Synthetic
aggcaugacucuccugauu

SEQ ID NO: 833 - RNA, 19 nt, Artificial Sequence
  Synthetic
auaaccaaauuagcagcag

SEQ ID NO: 834 - RNA, 19 nt, Artificial Sequence
  Synthetic
auagcacaaucuucuacca

SEQ ID NO: 835 - RNA, 19 nt, Artificial Sequence
  Synthetic
ggugcagggcaagugaugu

SEQ ID NO: 836 - RNA, 19 nt, Artificial Sequence
  Synthetic
ccucacuucuccaguguag

SEQ ID NO: 837 - RNA, 19 nt, Artificial Sequence
  Synthetic
cuaccaaauuccuagaauc

SEQ ID NO: 838 - RNA, 19 nt, Artificial Sequence
  Synthetic
aucagacaaacgauaauau

SEQ ID NO: 839 - RNA, 19 nt, Artificial Sequence
  Synthetic
uaacagcaagauuagauag

SEQ ID NO: 840 - RNA, 19 nt, Artificial Sequence
  Synthetic
cugcucgggaugguauaag

SEQ ID NO: 841 - RNA, 19 nt, Artificial Sequence
  Synthetic
ucuuagaaaaagacgauga

SEQ ID NO: 842 - RNA, 19 nt, Artificial Sequence
  Synthetic
caagaagugcagugcuagc

SEQ ID NO: 843 - RNA, 19 nt, Artificial Sequence
  Synthetic
aauacauaaagccacaaag

SEQ ID NO: 844 - RNA, 19 nt, Artificial Sequence
  Synthetic
gucaauuuauaguagaucu

SEQ ID NO: 845 - RNA, 19 nt, Artificial Sequence
  Synthetic
cucaaauaaguuaauaaaa

SEQ ID NO: 846 - RNA, 19 nt, Artificial Sequence
  Synthetic
auaaucauuggaggaaauc

SEQ ID NO: 847 - RNA, 19 nt, Artificial Sequence
  Synthetic
ccaucaugauugcaauacu

SEQ ID NO: 848 - RNA, 19 nt, Artificial Sequence
  Synthetic
ucaacuucacuuauaauug

SEQ ID NO: 849 - RNA, 19 nt, Artificial Sequence
  Synthetic
gcagccaucauauucauag

SEQ ID NO: 850 - RNA, 19 nt, Artificial Sequence
  Synthetic
accccaacauaccucaccc

SEQ ID NO: 851 - RNA, 19 nt, Artificial Sequence
  Synthetic
aagucaacccugcaaucca

SEQ ID NO: 852 - RNA, 19 nt, Artificial Sequence
  Synthetic
acaacagucaagaccaaaa

SEQ ID NO: 853 - RNA, 19 nt, Artificial Sequence
  Synthetic
accacaaaacaacgccaaa

SEQ ID NO: 854 - RNA, 19 nt, Artificial Sequence
  Synthetic
uuugaaguguucaacuuug

SEQ ID NO: 855 - RNA, 19 nt, Artificial Sequence
  Synthetic
aagcccacaaaaaaaccaa

SEQ ID NO: 856 - RNA, 19 nt, Artificial Sequence
  Synthetic
uaauaucaaggaaaauaag

SEQ ID NO: 857 - RNA, 19 nt, Artificial Sequence
  Synthetic
uaagguaaaauugauaaaa

SEQ ID NO: 858 - RNA, 19 nt, Artificial Sequence
  Synthetic
acaagaauuagauaaauau

SEQ ID NO: 859 - RNA, 19 nt, Artificial Sequence
  Synthetic
gcaccuagaaggggaagug

SEQ ID NO: 860 - RNA, 19 nt, Artificial Sequence
  Synthetic
ggcuguagucagcuuauca

SEQ ID NO: 861 - RNA, 19 nt, Artificial Sequence
  Synthetic
aaauggaguuagugucuua

SEQ ID NO: 862 - RNA, 19 nt, Artificial Sequence
  Synthetic
aacugugauagaguuccaa

SEQ ID NO: 863 - RNA, 19 nt, Artificial Sequence
  Synthetic
auuuaguguuaaugcaggu

SEQ ID NO: 864 - RNA, 19 nt, Artificial Sequence
  Synthetic
uguaacuacaccuguaagc

SEQ ID NO: 865 - RNA, 19 nt, Artificial Sequence
  Synthetic
auucaaccccaaauaugau

SEQ ID NO: 866 - RNA, 19 nt, Artificial Sequence
  Synthetic
auuuucuaacgggugcgau

SEQ ID NO: 867 - RNA, 19 nt, Artificial Sequence
  Synthetic
ccagagccuagcauuuauu

SEQ ID NO: 868 - RNA, 19 nt, Artificial Sequence
  Synthetic
auuacauaauguaaaugcu

SEQ ID NO: 869 - RNA, 19 nt, Artificial Sequence
  Synthetic
uaguaacuaaauaaaaaua

SEQ ID NO: 870 - RNA, 19 nt, Artificial Sequence
  Synthetic
aacucucaucuauaaacca

SEQ ID NO: 871 - RNA, 19 nt, Artificial Sequence
  Synthetic
aacuggggcaaauauguca

SEQ ID NO: 872 - RNA, 19 nt, Artificial Sequence
  Synthetic
gugucauuuuagucauaau

SEQ ID NO: 873 - RNA, 19 nt, Artificial Sequence
  Synthetic
ccaugcacugcuuguaaga

SEQ ID NO: 874 - RNA, 19 nt, Artificial Sequence
  Synthetic
aaaagaaucaacuguuagu

SEQ ID NO: 875 - RNA, 19 nt, Artificial Sequence
  Synthetic
uuacuauguauaaucaaaa

SEQ ID NO: 876 - RNA, 19 nt, Artificial Sequence
  Synthetic
uccauuggaccucucaaga

SEQ ID NO: 877 - RNA, 19 nt, Artificial Sequence
  Synthetic
aaaauuuucuacaacaucu

SEQ ID NO: 878 - RNA, 19 nt, Artificial Sequence
  Synthetic
aaccuacuuauuuucaguc

SEQ ID NO: 879 - RNA, 19 nt, Artificial Sequence
  Synthetic
auggacaagaugaagacaa

SEQ ID NO: 880 - RNA, 19 nt, Artificial Sequence
  Synthetic
uaggcuuaagaugcggauu

SEQ ID NO: 881 - RNA, 19 nt, Artificial Sequence
  Synthetic
cucagaaaaaucugcuauc

SEQ ID NO: 882 - RNA, 19 nt, Artificial Sequence
  Synthetic
aaaauuauauagaacauga

SEQ ID NO: 883 - RNA, 19 nt, Artificial Sequence
  Synthetic
uagaauugaaagcaggaau

SEQ ID NO: 884 - RNA, 19 nt, Artificial Sequence
  Synthetic
uaggccacaaauuaaaagg

SEQ ID NO: 885 - RNA, 19 nt, Artificial Sequence
  Synthetic
cagcuaguauaaagaaagu

SEQ ID NO: 886 - RNA, 19 nt, Artificial Sequence
  Synthetic
uaaaaaaucaugcauuaug

SEQ ID NO: 887 - RNA, 19 nt, Artificial Sequence
  Synthetic
aagauaaacuucaagaucu

SEQ ID NO: 888 - RNA, 19 nt, Artificial Sequence
  Synthetic
cuagcgaaaucaauagacu

SEQ ID NO: 889 - RNA, 19 nt, Artificial Sequence
  Synthetic
guggugagagaggacccac

SEQ ID NO: 890 - RNA, 19 nt, Artificial Sequence
  Synthetic
aaaaacagagagaucaaau

SEQ ID NO: 891 - RNA, 19 nt, Artificial Sequence
  Synthetic
auaaaacacucaaaucugg

SEQ ID NO: 892 - RNA, 19 nt, Artificial Sequence
  Synthetic
auuggauucugauuauaca

SEQ ID NO: 893 - RNA, 19 nt, Artificial Sequence
  Synthetic
uaacugaucauauguucau

SEQ ID NO: 894 - RNA, 19 nt, Artificial Sequence
  Synthetic
agcuggagugugauaugaa

SEQ ID NO: 895 - RNA, 19 nt, Artificial Sequence
  Synthetic
aacgucuuaauguagcaga

SEQ ID NO: 896 - RNA, 19 nt, Artificial Sequence
  Synthetic
aauucacaguuugcccuug

SEQ ID NO: 897 - RNA, 19 nt, Artificial Sequence
  Synthetic
uaaggauugcuaauucuga

SEQ ID NO: 898 - RNA, 19 nt, Artificial Sequence
  Synthetic
agacacugaaugacuauug

SEQ ID NO: 899 - RNA, 19 nt, Artificial Sequence
  Synthetic
gcaaacaagauuuguauaa

SEQ ID NO: 900 - RNA, 19 nt, Artificial Sequence
  Synthetic
aucauucagguaauacagc

SEQ ID NO: 901 - RNA, 19 nt, Artificial Sequence
  Synthetic
aguuuuuaaggcuguacaa

SEQ ID NO: 902 - RNA, 19 nt, Artificial Sequence
  Synthetic
gucuuuuugucugugaugc

SEQ ID NO: 903 - RNA, 19 nt, Artificial Sequence
  Synthetic
aaacuuauguaugcuuagg

SEQ ID NO: 904 - RNA, 19 nt, Artificial Sequence
  Synthetic
cugaaguuuacuuaguccu

SEQ ID NO: 905 - RNA, 19 nt, Artificial Sequence
  Synthetic
acaucuuaaaaugguucaa

SEQ ID NO: 906 - RNA, 19 nt, Artificial Sequence
  Synthetic
auucuucacuucaccauca

SEQ ID NO: 907 - RNA, 19 nt, Artificial Sequence
  Synthetic
aaacucaugcucaagcaga

SEQ ID NO: 908 - RNA, 19 nt, Artificial Sequence
  Synthetic
uauuauugcguacaguagu

SEQ ID NO: 909 - RNA, 19 nt, Artificial Sequence
  Synthetic
cauaugaagaaauaaauga

SEQ ID NO: 910 - RNA, 19 nt, Artificial Sequence
  Synthetic
ugguaaauccaccauaaau

SEQ ID NO: 911 - RNA, 19 nt, Artificial Sequence
  Synthetic
caaacuugcguaaaccaaa

SEQ ID NO: 912 - RNA, 19 nt, Artificial Sequence
  Synthetic
ugcuauacugacaaauuaa

SEQ ID NO: 913 - RNA, 19 nt, Artificial Sequence
  Synthetic
cacaccacaaagacugaug

SEQ ID NO: 914 - RNA, 19 nt, Artificial Sequence
  Synthetic
agacaucauaacacacaga

SEQ ID NO: 915 - RNA, 19 nt, Artificial Sequence
  Synthetic
caauccaugaauuucaaca

SEQ ID NO: 916 - RNA, 19 nt, Artificial Sequence
  Synthetic
ggggauagaucuggucuua

SEQ ID NO: 917 - RNA, 19 nt, Artificial Sequence
  Synthetic
gauauagccaacagcuucu

SEQ ID NO: 918 - RNA, 19 nt, Artificial Sequence
  Synthetic
gcaaaaucaguuaaaaaua

SEQ ID NO: 919 - RNA, 19 nt, Artificial Sequence
  Synthetic
aguguauuagacuugacag

SEQ ID NO: 920 - RNA, 19 nt, Artificial Sequence
  Synthetic
caucaccuaaagaucccaa

SEQ ID NO: 921 - RNA, 19 nt, Artificial Sequence
  Synthetic
auaaucccuuuucaaaacu

SEQ ID NO: 922 - RNA, 19 nt, Artificial Sequence
  Synthetic
aagaagaaucuagcuauuc

SEQ ID NO: 923 - RNA, 19 nt, Artificial Sequence
  Synthetic
uucacacauuaguaguagc

SEQ ID NO: 924 - RNA, 19 nt, Artificial Sequence
  Synthetic
agaaauugaacaaccuguu

SEQ ID NO: 925 - RNA, 19 nt, Artificial Sequence
  Synthetic
cacaacaccaacagaagac

SEQ ID NO: 926 - RNA, 19 nt, Artificial Sequence
  Synthetic
auauguuaacuacaguuaa

SEQ ID NO: 927 - RNA, 19 nt, Artificial Sequence
  Synthetic
acuaacaauaacguugggg

SEQ ID NO: 928 - RNA, 19 nt, Artificial Sequence
  Synthetic
aagaccugggacacucuca

SEQ ID NO: 929 - RNA, 19 nt, Artificial Sequence
  Synthetic
uuaaaucuuaaaucuauag

SEQ ID NO: 930 - RNA, 19 nt, Artificial Sequence
  Synthetic
gucacacuaacaacugcaa

SEQ ID NO: 931 - RNA, 19 nt, Artificial Sequence
  Synthetic
aucagcuucuccaaucugu

SEQ ID NO: 932 - RNA, 19 nt, Artificial Sequence
  Synthetic
accaccaccauacuagcuu

SEQ ID NO: 933 - RNA, 19 nt, Artificial Sequence
  Synthetic
aacaaaccaccaaacaaac

SEQ ID NO: 934 - RNA, 19 nt, Artificial Sequence
  Synthetic
ggaaagaaaaccaccacca

SEQ ID NO: 935 - RNA, 19 nt, Artificial Sequence
  Synthetic
aaagaucucaaaccucaaa

SEQ ID NO: 936 - RNA, 19 nt, Artificial Sequence
  Synthetic
ucuuagugcucuaagaacu

SEQ ID NO: 937 - RNA, 19 nt, Artificial Sequence
  Synthetic
ugguugguauacuaguguu

SEQ ID NO: 938 - RNA, 19 nt, Artificial Sequence
  Synthetic
uuauacacucaacaauacc

SEQ ID NO: 939 - RNA, 19 nt, Artificial Sequence
  Synthetic
ugcaaucgccaguggcauu

SEQ ID NO: 940 - RNA, 19 nt, Artificial Sequence
  Synthetic
aacauguaaaguucaaucg

SEQ ID NO: 941 - RNA, 19 nt, Artificial Sequence
  Synthetic
gaaucgaguauuuugugac

SEQ ID NO: 942 - RNA, 19 nt, Artificial Sequence
  Synthetic
uguaaauaagcaagaaggc

SEQ ID NO: 943 - RNA, 19 nt, Artificial Sequence
  Synthetic
caaaagucucuauguaaaa

SEQ ID NO: 944 - RNA, 19 nt, Artificial Sequence
  Synthetic
agucaaugagaagauuaac

SEQ ID NO: 945 - RNA, 19 nt, Artificial Sequence
  Synthetic
caaggaucaacugaguggu

SEQ ID NO: 946 - RNA, 19 nt, Artificial Sequence
  Synthetic
uaucauuggauuuucuuaa

SEQ ID NO: 947 - RNA, 19 nt, Artificial Sequence
  Synthetic
gaauaccagauuaacuuac

SEQ ID NO: 948 - RNA, 19 nt, Artificial Sequence
  Synthetic
agaaauuaauguguucaau

SEQ ID NO: 949 - RNA, 19 nt, Artificial Sequence
  Synthetic
auuuauacacaaaauuaaa

SEQ ID NO: 950 - RNA, 19 nt, Artificial Sequence
  Synthetic
uuuugaaucaauaugguug

SEQ ID NO: 951 - RNA, 19 nt, Artificial Sequence
  Synthetic
uauuagauaagacaguauc

SEQ ID NO: 952 - RNA, 19 nt, Artificial Sequence
  Synthetic
uaagcaguuugaguauguu

SEQ ID NO: 953 - RNA, 19 nt, Artificial Sequence
  Synthetic
auaugccgucacacauaca

SEQ ID NO: 954 - RNA, 19 nt, Artificial Sequence
  Synthetic
caccccccuauauaagaga

SEQ ID NO: 955 - RNA, 19 nt, Artificial Sequence
  Synthetic
guaacaauaaauuauauuu

SEQ ID NO: 956 - RNA, 19 nt, Artificial Sequence
  Synthetic
cuccugauuuccucacaga

SEQ ID NO: 957 - RNA, 19 nt, Artificial Sequence
  Synthetic
aaccuacauauccucacgg

SEQ ID NO: 958 - RNA, 19 nt, Artificial Sequence
  Synthetic
uggaaaagacuucugccau

SEQ ID NO: 959 - RNA, 19 nt, Artificial Sequence
  Synthetic
acaucaaauauacaacaag

SEQ ID NO: 960 - RNA, 19 nt, Artificial Sequence
  Synthetic
gcacuauagcuaguggcau

SEQ ID NO: 961 - RNA, 19 nt, Artificial Sequence
  Synthetic
aaaaauuauuuccacaaua

SEQ ID NO: 962 - RNA, 19 nt, Artificial Sequence
  Synthetic
uuggccuuagcuuaauguc

SEQ ID NO: 963 - RNA, 19 nt, Artificial Sequence
  Synthetic
ucuuuuacauuaauuauaa

SEQ ID NO: 964 - RNA, 19 nt, Artificial Sequence
  Synthetic
aucuauuaacuaaacauau

SEQ ID NO: 965 - RNA, 19 nt, Artificial Sequence
  Synthetic
auagcacaucacuuuauug

SEQ ID NO: 966 - RNA, 19 nt, Artificial Sequence
  Synthetic
aguauauuuuaaaagaccu

SEQ ID NO: 967 - RNA, 19 nt, Artificial Sequence
  Synthetic
auguaagaaaaugcaagua

SEQ ID NO: 968 - RNA, 19 nt, Artificial Sequence
  Synthetic
aauguacguuaauaguaaa

SEQ ID NO: 969 - RNA, 19 nt, Artificial Sequence
  Synthetic
uuacaauagguccugcaaa

SEQ ID NO: 970 - RNA, 19 nt, Artificial Sequence
  Synthetic
acagcuugacaacuaauga

SEQ ID NO: 971 - RNA, 19 nt, Artificial Sequence
  Synthetic
uuaucauuuugaucuagga

SEQ ID NO: 972 - RNA, 19 nt, Artificial Sequence
  Synthetic
auaaauaucaacuagcaaa

SEQ ID NO: 973 - RNA, 19 nt, Artificial Sequence
  Synthetic
ugacagaagauaaaaaugg

SEQ ID NO: 974 - RNA, 19 nt, Artificial Sequence
  Synthetic
agccgacccaaccauggac

SEQ ID NO: 975 - RNA, 19 nt, Artificial Sequence
  Synthetic
cacaacacacaaugacacc

SEQ ID NO: 976 - RNA, 19 nt, Artificial Sequence
  Synthetic
gaucacagacaugagacca

SEQ ID NO: 977 - RNA, 19 nt, Artificial Sequence
  Synthetic
auugucacuugagacuaua

SEQ ID NO: 978 - RNA, 19 nt, Artificial Sequence
  Synthetic
aauaauaucacuaaccaga

SEQ ID NO: 979 - RNA, 19 nt, Artificial Sequence
  Synthetic
ucaugaauguauagugaga

SEQ ID NO: 980 - RNA, 19 nt, Artificial Sequence
  Synthetic
acuauugcacaaaguggga

SEQ ID NO: 981 - RNA, 19 nt, Artificial Sequence
  Synthetic
aagcacuaaauacaaaaaa

SEQ ID NO: 982 - RNA, 19 nt, Artificial Sequence
  Synthetic
aaaauauggcacuuuuccu

SEQ ID NO: 983 - RNA, 19 nt, Artificial Sequence
  Synthetic
uaugccaauauuuaucaau

SEQ ID NO: 984 - RNA, 19 nt, Artificial Sequence
  Synthetic
uacaaagcacacucccaua

SEQ ID NO: 985 - RNA, 19 nt, Artificial Sequence
  Synthetic
acaagagucacacaaucug

SEQ ID NO: 986 - RNA, 19 nt, Artificial Sequence
  Synthetic
gaaauaacaacuucaugca

SEQ ID NO: 987 - RNA, 19 nt, Artificial Sequence
  Synthetic
auaaccacacuccauaguu

SEQ ID NO: 988 - RNA, 19 nt, Artificial Sequence
  Synthetic
ucaaauggagccugaaaau

SEQ ID NO: 989 - RNA, 19 nt, Artificial Sequence
  Synthetic
aaggagagacauaagauga

SEQ ID NO: 990 - RNA, 19 nt, Artificial Sequence
  Synthetic
aaagauggggcaaauacaa

SEQ ID NO: 991 - RNA, 19 nt, Artificial Sequence
  Synthetic
aaaauggcucuuagcaaag

SEQ ID NO: 992 - RNA, 19 nt, Artificial Sequence
  Synthetic
ucuagauuaggaagagaag

SEQ ID NO: 993 - RNA, 19 nt, Artificial Sequence
  Synthetic
guaaaagcaaauggagugg

SEQ ID NO: 994 - RNA, 19 nt, Artificial Sequence
  Synthetic
uuaacauugucaagcuuaa

SEQ ID NO: 995 - RNA, 19 nt, Artificial Sequence
  Synthetic
uguauagcggcauuaguaa

SEQ ID NO: 996 - RNA, 19 nt, Artificial Sequence
  Synthetic
acagcugugauuaggaggg

SEQ ID NO: 997 - RNA, 19 nt, Artificial Sequence
  Synthetic
aaugaaaugaaacguuaua

SEQ ID NO: 998 - RNA, 19 nt, Artificial Sequence
  Synthetic
uaugaaguguuugaaaaau

SEQ ID NO: 999 - RNA, 19 nt, Artificial Sequence
  Synthetic
uauccucacuuuauagaug

SEQ ID NO: 1000 - RNA, 19 nt, Artificial Sequence
  Synthetic
gaagggauuuuugcuggau

SEQ ID NO: 1001 - RNA, 19 nt, Artificial Sequence
  Synthetic
uuacgguggggggucuuag

SEQ ID NO: 1002 - RNA, 19 nt, Artificial Sequence
  Synthetic
auuaugcuaggacacgcua

SEQ ID NO: 1003 - RNA, 19 nt, Artificial Sequence
  Synthetic
gaacaaguuguggagguuu

SEQ ID NO: 1004 - RNA, 19 nt, Artificial Sequence
  Synthetic
uuggguggagaagcagggu

SEQ ID NO: 1005 - RNA, 19 nt, Artificial Sequence
  Synthetic
uugucuuugacucaauuuc

SEQ ID NO: 1006 - RNA, 19 nt, Artificial Sequence
  Synthetic
gaauacagagguacaccaa

SEQ ID NO: 1007 - RNA, 19 nt, Artificial Sequence
  Synthetic
gaugcugcaaaagcauaug

SEQ ID NO: 1008 - RNA, 19 nt, Artificial Sequence
  Synthetic
aagaugcaaacaacagagc

SEQ ID NO: 1009 - RNA, 19 nt, Artificial Sequence
  Synthetic
auucaaccauuauaaaccc

SEQ ID NO: 1010 - RNA, 19 nt, Artificial Sequence
  Synthetic
auacuguagggaacaagcc

SEQ ID NO: 1011 - RNA, 19 nt, Artificial Sequence
  Synthetic
aagacccuacgccaaguga

SEQ ID NO: 1012 - RNA, 19 nt, Artificial Sequence
  Synthetic
cgagugcaggaccuacauc

SEQ ID NO: 1013 - RNA, 19 nt, Artificial Sequence
  Synthetic
gacuagaagcuauggcaag

SEQ ID NO: 1014 - RNA, 19 nt, Artificial Sequence
  Synthetic
augauuucugaucaguuac

SEQ ID NO: 1015 - RNA, 19 nt, Artificial Sequence
  Synthetic
ccaaucuguacaucaacac

SEQ ID NO: 1016 - RNA, 19 nt, Artificial Sequence
  Synthetic
ccaacaaacaaaccaacuc

SEQ ID NO: 1017 - RNA, 19 nt, Artificial Sequence
  Synthetic
cacccauccaaccaaacau

SEQ ID NO: 1018 - RNA, 19 nt, Artificial Sequence
  Synthetic
ucuauacgccaaucagcca

SEQ ID NO: 1019 - RNA, 19 nt, Artificial Sequence
  Synthetic
aauccaaaacuagccaccc

SEQ ID NO: 1020 - RNA, 19 nt, Artificial Sequence
  Synthetic
cggaaaaaauagauacuau

SEQ ID NO: 1021 - RNA, 19 nt, Artificial Sequence
  Synthetic
uaguuacaaaaaaagaugg

SEQ ID NO: 1022 - RNA, 19 nt, Artificial Sequence
  Synthetic
acgugaacaaacuucacga

SEQ ID NO: 1023 - RNA, 19 nt, Artificial Sequence
  Synthetic
aaucauccaugccagcaga

SEQ ID NO: 1024 - RNA, 19 nt, Artificial Sequence
  Synthetic
uuaccauaugugccaaugu

SEQ ID NO: 1025 - RNA, 19 nt, Artificial Sequence
  Synthetic
gcaagcuggcauaugaugu

SEQ ID NO: 1026 - RNA, 19 nt, Artificial Sequence
  Synthetic
aagaucucacuaugaaaac

SEQ ID NO: 1027 - RNA, 19 nt, Artificial Sequence
  Synthetic
cacucaacccaacacauga

SEQ ID NO: 1028 - RNA, 19 nt, Artificial Sequence
  Synthetic
acaucauugcuuuauguga

SEQ ID NO: 1029 - RNA, 19 nt, Artificial Sequence
  Synthetic
aauuugaaaauauaguaac

SEQ ID NO: 1030 - RNA, 19 nt, Artificial Sequence
  Synthetic
aauucaaaaaugccaucac

SEQ ID NO: 1031 - RNA, 19 nt, Artificial Sequence
  Synthetic
cuuacucaggauuacuguu

SEQ ID NO: 1032 - RNA, 19 nt, Artificial Sequence
  Synthetic
uuacaacaaauuggaagca

SEQ ID NO: 1033 - RNA, 19 nt, Artificial Sequence
  Synthetic
auuaaccuuuuucuucuac

SEQ ID NO: 1034 - RNA, 19 nt, Artificial Sequence
  Synthetic
caucagugaguugauucau

SEQ ID NO: 1035 - RNA, 19 nt, Artificial Sequence
  Synthetic
auaaucaccaacccucugu

SEQ ID NO: 1036 - RNA, 19 nt, Artificial Sequence
  Synthetic
ugguucaacuaaucaaaca

SEQ ID NO: 1037 - RNA, 19 nt, Artificial Sequence
  Synthetic
aaaacccaucuggagccuc

SEQ ID NO: 1038 - RNA, 19 nt, Artificial Sequence
  Synthetic
uguucaucagaucuaguac

SEQ ID NO: 1039 - RNA, 19 nt, Artificial Sequence
  Synthetic
aauauccacauggggcaaa

SEQ ID NO: 1040 - RNA, 19 nt, Artificial Sequence
  Synthetic
ugucaacauagacaaguca

SEQ ID NO: 1041 - RNA, 19 nt, Artificial Sequence
  Synthetic
ugauaacaacaauaaucuc

SEQ ID NO: 1042 - RNA, 19 nt, Artificial Sequence
  Synthetic
aaaccuuugagcuaccaag

SEQ ID NO: 1043 - RNA, 19 nt, Artificial Sequence
  Synthetic
gagcucgagucaauacaua

SEQ ID NO: 1044 - RNA, 19 nt, Artificial Sequence
  Synthetic
agcauucaccaaucugaug

SEQ ID NO: 1045 - RNA, 19 nt, Artificial Sequence
  Synthetic
ggcacaaaacaguaaccuu

SEQ ID NO: 1046 - RNA, 19 nt, Artificial Sequence
  Synthetic
ugcauuuguaagugaacaa

SEQ ID NO: 1047 - RNA, 19 nt, Artificial Sequence
  Synthetic
acccucaccucuuuacaaa

SEQ ID NO: 1048 - RNA, 19 nt, Artificial Sequence
  Synthetic
aaccacaucaacaucucac

SEQ ID NO: 1049 - RNA, 19 nt, Artificial Sequence
  Synthetic
ccaugcaagccaucaucca

SEQ ID NO: 1050 - RNA, 19 nt, Artificial Sequence
  Synthetic
auauuauaaaguaguuaau

SEQ ID NO: 1051 - RNA, 19 nt, Artificial Sequence
  Synthetic
uuaaaaauaaucauaacaa

SEQ ID NO: 1052 - RNA, 19 nt, Artificial Sequence
  Synthetic
augaacuaagauauuaaga

SEQ ID NO: 1053 - RNA, 19 nt, Artificial Sequence
  Synthetic
aaucaucuauuauucauau

SEQ ID NO: 1054 - RNA, 19 nt, Artificial Sequence
  Synthetic
ucaucgugcuuauacaagu

SEQ ID NO: 1055 - RNA, 19 nt, Artificial Sequence
  Synthetic
cagaauccccagcuuggaa

SEQ ID NO: 1056 - RNA, 19 nt, Artificial Sequence
  Synthetic
ucugaaacuacaucacaaa

SEQ ID NO: 1057 - RNA, 19 nt, Artificial Sequence
  Synthetic
ucaacaacaccaaguguca

SEQ ID NO: 1058 - RNA, 19 nt, Artificial Sequence
  Synthetic
aacacaacaacaaccaaaa

SEQ ID NO: 1059 - RNA, 19 nt, Artificial Sequence
  Synthetic
auacaacccagcaagccca

SEQ ID NO: 1060 - RNA, 19 nt, Artificial Sequence
  Synthetic
guaccuugcagcauaugca

SEQ ID NO: 1061 - RNA, 19 nt, Artificial Sequence
  Synthetic
ugggcuaucuguaaaagaa

SEQ ID NO: 1062 - RNA, 19 nt, Artificial Sequence
  Synthetic
auaccaaacaaaaaaccug

SEQ ID NO: 1063 - RNA, 19 nt, Artificial Sequence
  Synthetic
accaucaagacaaccaaaa

SEQ ID NO: 1064 - RNA, 19 nt, Artificial Sequence
  Synthetic
accacaaaaccaaaggaag

SEQ ID NO: 1065 - RNA, 19 nt, Artificial Sequence
  Synthetic
guaccuaccaccaagccca

SEQ ID NO: 1066 - RNA, 19 nt, Artificial Sequence
  Synthetic
acagaaaagccaaccauca

SEQ ID NO: 1067 - RNA, 19 nt, Artificial Sequence
  Synthetic
aucagaacuacacugcuca

SEQ ID NO: 1068 - RNA, 19 nt, Artificial Sequence
  Synthetic
accaacaauaccacaggaa

SEQ ID NO: 1069 - RNA, 19 nt, Artificial Sequence
  Synthetic
aauccagaacacacaaguc

SEQ ID NO: 1070 - RNA, 19 nt, Artificial Sequence
  Synthetic
caaaagggaacccuccacu

SEQ ID NO: 1071 - RNA, 19 nt, Artificial Sequence
  Synthetic
ucaaccuccuccgauggca

SEQ ID NO: 1072 - RNA, 19 nt, Artificial Sequence
  Synthetic
aauccaagcccuucacaag

SEQ ID NO: 1073 - RNA, 19 nt, Artificial Sequence
  Synthetic
gucuauacaacauccgagu

SEQ ID NO: 1074 - RNA, 19 nt, Artificial Sequence
  Synthetic
uaccuaucacaaccuccau

SEQ ID NO: 1075 - RNA, 19 nt, Artificial Sequence
  Synthetic
ucuccauccaacacaacaa

SEQ ID NO: 1076 - RNA, 19 nt, Artificial Sequence
  Synthetic
aaccaguagucauuaaaaa

SEQ ID NO: 1077 - RNA, 19 nt, Artificial Sequence
  Synthetic
agcguauuauugcaaaaag

SEQ ID NO: 1078 - RNA, 19 nt, Artificial Sequence
  Synthetic
gccaugaccaaaucaacca

SEQ ID NO: 1079 - RNA, 19 nt, Artificial Sequence
  Synthetic
agaaucaaaaucaacucug

SEQ ID NO: 1080 - RNA, 19 nt, Artificial Sequence
  Synthetic
guugccaauccucaaaaca

SEQ ID NO: 1081 - RNA, 19 nt, Artificial Sequence
  Synthetic
aaaugcaauuaccgcaauc

SEQ ID NO: 1082 - RNA, 19 nt, Artificial Sequence
  Synthetic
ccuugcugcagucacacuc

SEQ ID NO: 1083 - RNA, 19 nt, Artificial Sequence
  Synthetic
cuguuuugcuuccagucaa

SEQ ID NO: 1084 - RNA, 19 nt, Artificial Sequence
  Synthetic
ugcagucagcaaaggcuau

SEQ ID NO: 1085 - RNA, 19 nt, Artificial Sequence
  Synthetic
uaaaagugcuguaacagaa

SEQ ID NO: 1086 - RNA, 19 nt, Artificial Sequence
  Synthetic
aagcacaccggcaaccaac

SEQ ID NO: 1087 - RNA, 19 nt, Artificial Sequence
  Synthetic
caaaaauaccaauguaaca

SEQ ID NO: 1088 - RNA, 19 nt, Artificial Sequence
  Synthetic
aagaagauuucuuggcuuu

SEQ ID NO: 1089 - RNA, 19 nt, Artificial Sequence
  Synthetic
uaaacaguuguuaccuauu

SEQ ID NO: 1090 - RNA, 19 nt, Artificial Sequence
  Synthetic
ugugaacaagcaaagcugu

SEQ ID NO: 1091 - RNA, 19 nt, Artificial Sequence
  Synthetic
uagcauaucaaacauugaa

SEQ ID NO: 1092 - RNA, 19 nt, Artificial Sequence
  Synthetic
cacuuauauguuaacaaau

SEQ ID NO: 1093 - RNA, 19 nt, Artificial Sequence
  Synthetic
uagugaauuauuaucauua

SEQ ID NO: 1094 - RNA, 19 nt, Artificial Sequence
  Synthetic
cauaauaaaggaggaaguc

SEQ ID NO: 1095 - RNA, 19 nt, Artificial Sequence
  Synthetic
auuaccacuauauggugua

SEQ ID NO: 1096 - RNA, 19 nt, Artificial Sequence
  Synthetic
aauagauacaccuuguugg

SEQ ID NO: 1097 - RNA, 19 nt, Artificial Sequence
  Synthetic
aaaggaaggguccaacauc

SEQ ID NO: 1098 - RNA, 19 nt, Artificial Sequence
  Synthetic
cuguuuaacaagaaccgac

SEQ ID NO: 1099 - RNA, 19 nt, Artificial Sequence
  Synthetic
uuucuucccacuagcugaa

SEQ ID NO: 1100 - RNA, 19 nt, Artificial Sequence
  Synthetic
ucucugcaacauugacaua

SEQ ID NO: 1101 - RNA, 19 nt, Artificial Sequence
  Synthetic
uugcaaaauuaugacuuca

SEQ ID NO: 1102 - RNA, 19 nt, Artificial Sequence
  Synthetic
uuauguaucaaauaagggg

SEQ ID NO: 1103 - RNA, 19 nt, Artificial Sequence
  Synthetic
agguaauacauuauauuau

SEQ ID NO: 1104 - RNA, 19 nt, Artificial Sequence
  Synthetic
uuucuaugacccauuagug

SEQ ID NO: 1105 - RNA, 19 nt, Artificial Sequence
  Synthetic
guuccccucugaugaauuu

SEQ ID NO: 1106 - RNA, 19 nt, Artificial Sequence
  Synthetic
ugccguuggacugcuccua

SEQ ID NO: 1107 - RNA, 19 nt, Artificial Sequence
  Synthetic
auacugcaaggccagaagc

SEQ ID NO: 1108 - RNA, 19 nt, Artificial Sequence
  Synthetic
uacaaugguuucauaucug

SEQ ID NO: 1109 - RNA, 19 nt, Artificial Sequence
  Synthetic
aucucacuuacauuauuua

SEQ ID NO: 1110 - RNA, 19 nt, Artificial Sequence
  Synthetic
uaguuauauaaaacaauug

SEQ ID NO: 1111 - RNA, 19 nt, Artificial Sequence
  Synthetic
cuauuuguaaaaaaugaga

SEQ ID NO: 1112 - RNA, 19 nt, Artificial Sequence
  Synthetic
uugcuugaaugguaagagg

SEQ ID NO: 1113 - RNA, 19 nt, Artificial Sequence
  Synthetic
aacagaagaguaugcccuc

SEQ ID NO: 1114 - RNA, 19 nt, Artificial Sequence
  Synthetic
cgguguaguuggagugcua

SEQ ID NO: 1115 - RNA, 19 nt, Artificial Sequence
  Synthetic
agagaguuauauaggaucu

SEQ ID NO: 1116 - RNA, 19 nt, Artificial Sequence
  Synthetic
uauaaauaauauaacuaaa

SEQ ID NO: 1117 - RNA, 19 nt, Artificial Sequence
  Synthetic
ugaacucaacagugaugac

SEQ ID NO: 1118 - RNA, 19 nt, Artificial Sequence
  Synthetic
caucaaaaaacugagggac

SEQ ID NO: 1119 - RNA, 19 nt, Artificial Sequence
  Synthetic
caaugaagagccaaauuca

SEQ ID NO: 1120 - RNA, 19 nt, Artificial Sequence
  Synthetic
gaaaaccauaaaaaccaca

SEQ ID NO: 1121 - RNA, 19 nt, Artificial Sequence
  Synthetic
auuggauauccacaagagc

SEQ ID NO: 1122 - RNA, 19 nt, Artificial Sequence
  Synthetic
cauaaccaucaauaaccca

SEQ ID NO: 1123 - RNA, 19 nt, Artificial Sequence
  Synthetic
ugauauaaacgaccaugcc

SEQ ID NO: 1124 - RNA, 19 nt, Artificial Sequence
  Synthetic
guauaaauuccauacuaau

SEQ ID NO: 1125 - RNA, 19 nt, Artificial Sequence
  Synthetic
uaacaaguaguuguagagu

SEQ ID NO: 1126 - RNA, 19 nt, Artificial Sequence
  Synthetic
aucaaaacaaccaaaauaa

SEQ ID NO: 1127 - RNA, 19 nt, Artificial Sequence
  Synthetic
accauauauacucaccgaa

SEQ ID NO: 1128 - RNA, 19 nt, Artificial Sequence
  Synthetic
aucaaccauucaaugaaau

SEQ ID NO: 1129 - RNA, 19 nt, Artificial Sequence
  Synthetic
acuugauugaugcaauuca

SEQ ID NO: 1130 - RNA, 19 nt, Artificial Sequence
  Synthetic
uagguauuacugaugauau

SEQ ID NO: 1131 - RNA, 19 nt, Artificial Sequence
  Synthetic
uauacacaauauauauauu

SEQ ID NO: 1132 - RNA, 19 nt, Artificial Sequence
  Synthetic
uccuaaugcuuaccacauc

SEQ ID NO: 1133 - RNA, 19 nt, Artificial Sequence
  Synthetic
caucaaacuauuaacucaa

SEQ ID NO: 1134 - RNA, 19 nt, Artificial Sequence
  Synthetic
aacaauucaagccauggga

SEQ ID NO: 1135 - RNA, 19 nt, Artificial Sequence
  Synthetic
auguguaucuaaccgauag

SEQ ID NO: 1136 - RNA, 19 nt, Artificial Sequence
  Synthetic
uuucuuucucagaauguaa

SEQ ID NO: 1137 - RNA, 19 nt, Artificial Sequence
  Synthetic
uaaaucuaaagaaacuaaa

SEQ ID NO: 1138 - RNA, 19 nt, Artificial Sequence
  Synthetic
gugaaauaaaaauagaaga

SEQ ID NO: 1139 - RNA, 19 nt, Artificial Sequence
  Synthetic
agaguaugaccucguuaga

SEQ ID NO: 1140 - RNA, 19 nt, Artificial Sequence
  Synthetic
aacagauuacuaccacuaa

SEQ ID NO: 1141 - RNA, 19 nt, Artificial Sequence
  Synthetic
uuagugaugucaaagucua

SEQ ID NO: 1142 - RNA, 19 nt, Artificial Sequence
  Synthetic
uggggcuuaaagaaaaaga

SEQ ID NO: 1143 - RNA, 19 nt, Artificial Sequence
  Synthetic
acucaguuauuacaaccau

SEQ ID NO: 1144 - RNA, 19 nt, Artificial Sequence
  Synthetic
uuuuagcuguuaaggauaa

SEQ ID NO: 1145 - RNA, 19 nt, Artificial Sequence
  Synthetic
cagucaaaaaucacucuac

SEQ ID NO: 1146 - RNA, 19 nt, Artificial Sequence
  Synthetic
caaaacaaaaagauacaau

SEQ ID NO: 1147 - RNA, 19 nt, Artificial Sequence
  Synthetic
aucgaucaagugagguaaa

SEQ ID NO: 1148 - RNA, 19 nt, Artificial Sequence
  Synthetic
aaaaccaugguuuuauauu

SEQ ID NO: 1149 - RNA, 19 nt, Artificial Sequence
  Synthetic
ugauagacaaucauacucu

SEQ ID NO: 1150 - RNA, 19 nt, Artificial Sequence
  Synthetic
ucaauggauuccaauuuau

SEQ ID NO: 1151 - RNA, 19 nt, Artificial Sequence
  Synthetic
ggauuaguaacuguuugaa

SEQ ID NO: 1152 - RNA, 19 nt, Artificial Sequence
  Synthetic
cacaacuauuccucuaugg

SEQ ID NO: 1153 - RNA, 19 nt, Artificial Sequence
  Synthetic
gagauuguauacuaaaacu

SEQ ID NO: 1154 - RNA, 19 nt, Artificial Sequence
  Synthetic
uauuccacaaugagggguu

SEQ ID NO: 1155 - RNA, 19 nt, Artificial Sequence
  Synthetic
gaaaacgguuuuauaauag

SEQ ID NO: 1156 - RNA, 19 nt, Artificial Sequence
  Synthetic
ugagugaauuauauuuuuu

SEQ ID NO: 1157 - RNA, 19 nt, Artificial Sequence
  Synthetic
uuaaaguuaauugcaacga

SEQ ID NO: 1158 - RNA, 19 nt, Artificial Sequence
  Synthetic
auagaauuauaaaaggauu

SEQ ID NO: 1159 - RNA, 19 nt, Artificial Sequence
  Synthetic
gauggccuacuuuaaggaa

SEQ ID NO: 1160 - RNA, 19 nt, Artificial Sequence
  Synthetic
cuuccuuguuggaacuuac

SEQ ID NO: 1161 - RNA, 19 nt, Artificial Sequence
  Synthetic
uuuuaucaggacuacguuu

SEQ ID NO: 1162 - RNA, 19 nt, Artificial Sequence
  Synthetic
uugaaaugaucauaaauga

SEQ ID NO: 1163 - RNA, 19 nt, Artificial Sequence
  Synthetic
auaaggcuauaucaccucc

SEQ ID NO: 1164 - RNA, 19 nt, Artificial Sequence
  Synthetic
gaguauuagaguacuauuu

SEQ ID NO: 1165 - RNA, 19 nt, Artificial Sequence
  Synthetic
guuaucuuaacaacccuaa

SEQ ID NO: 1166 - RNA, 19 nt, Artificial Sequence
  Synthetic
aucaugugguaucuuugac

SEQ ID NO: 1167 - RNA, 19 nt, Artificial Sequence
  Synthetic
uugcaaugcaaccaggaau

SEQ ID NO: 1168 - RNA, 19 nt, Artificial Sequence
  Synthetic
uguucagacaaguucaaau

SEQ ID NO: 1169 - RNA, 19 nt, Artificial Sequence
  Synthetic
uauuagcagagaaaaugau

SEQ ID NO: 1170 - RNA, 19 nt, Artificial Sequence
  Synthetic
uagaacuacagaaaauauu

SEQ ID NO: 1171 - RNA, 19 nt, Artificial Sequence
  Synthetic
guuacaaugauaauuacaa

SEQ ID NO: 1172 - RNA, 19 nt, Artificial Sequence
  Synthetic
cauuucgauaugaaacauc

SEQ ID NO: 1173 - RNA, 19 nt, Artificial Sequence
  Synthetic
uacuggaugaacugcaugg

SEQ ID NO: 1174 - RNA, 19 nt, Artificial Sequence
  Synthetic
auaugggugguaucgaagg

SEQ ID NO: 1175 - RNA, 19 nt, Artificial Sequence
  Synthetic
uagauauaaguaaaccagu

SEQ ID NO: 1176 - RNA, 19 nt, Artificial Sequence
  Synthetic
auagucuuaaauuacugua

SEQ ID NO: 1177 - RNA, 19 nt, Artificial Sequence
  Synthetic
caagagauaugcaauuuau

SEQ ID NO: 1178 - RNA, 19 nt, Artificial Sequence
  Synthetic
auagaggagaaagucuauu

SEQ ID NO: 1179 - RNA, 19 nt, Artificial Sequence
  Synthetic
aucaaauugcuuuacaacu

SEQ ID NO: 1180 - RNA, 19 nt, Artificial Sequence
  Synthetic
uguauaugaauuugcccau

SEQ ID NO: 1181 - RNA, 19 nt, Artificial Sequence
  Synthetic
auacaaaccaugauuuaaa

SEQ ID NO: 1182 - RNA, 19 nt, Artificial Sequence
  Synthetic
uaaucacauuugacaaaaa

SEQ ID NO: 1183 - RNA, 19 nt, Artificial Sequence
  Synthetic
ugagcacagcuccaaacaa

SEQ ID NO: 1184 - RNA, 19 nt, Artificial Sequence
  Synthetic
cacaacacuauaccacuac

SEQ ID NO: 1185 - RNA, 19 nt, Artificial Sequence
  Synthetic
aucuuauauccgguacaaa

SEQ ID NO: 1186 - RNA, 19 nt, Artificial Sequence
  Synthetic
ugcuuauaaggauauuucc

SEQ ID NO: 1187 - RNA, 19 nt, Artificial Sequence
  Synthetic
cauuagauuguaacagaga

SEQ ID NO: 1188 - RNA, 19 nt, Artificial Sequence
  Synthetic
auaaaagggaaauauugag

SEQ ID NO: 1189 - RNA, 19 nt, Artificial Sequence
  Synthetic
uugguguuacaucaccuag

SEQ ID NO: 1190 - RNA, 19 nt, Artificial Sequence
  Synthetic
uaaucauagagaaauauaa

SEQ ID NO: 1191 - RNA, 19 nt, Artificial Sequence
  Synthetic
aauucauggaagaacuuag

SEQ ID NO: 1192 - RNA, 19 nt, Artificial Sequence
  Synthetic
uaacauaugagaaagccaa

SEQ ID NO: 1193 - RNA, 19 nt, Artificial Sequence
  Synthetic
auuuaaguguuaacuauuu

SEQ ID NO: 1194 - RNA, 19 nt, Artificial Sequence
  Synthetic
cuuauagaacuacaaauua

SEQ ID NO: 1195 - RNA, 19 nt, Artificial Sequence
  Synthetic
aucacuuugauacuagccc

SEQ ID NO: 1196 - RNA, 19 nt, Artificial Sequence
  Synthetic
aagauauugauauaguauu

SEQ ID NO: 1197 - RNA, 19 nt, Artificial Sequence
  Synthetic
gaauuauucuuauaccuaa

SEQ ID NO: 1198 - RNA, 19 nt, Artificial Sequence
  Synthetic
uaaugaaaccucccauauu

SEQ ID NO: 1199 - RNA, 19 nt, Artificial Sequence
  Synthetic
auuuaauauuggcgcauaa

SEQ ID NO: 1200 - RNA, 19 nt, Artificial Sequence
  Synthetic
agauaucugacuauuuuca

SEQ ID NO: 1201 - RNA, 19 nt, Artificial Sequence
  Synthetic
aggguauuuuugaaaaaga

SEQ ID NO: 1202 - RNA, 19 nt, Artificial Sequence
  Synthetic
aagguuacggcagagcaaa

SEQ ID NO: 1203 - RNA, 19 nt, Artificial Sequence
  Synthetic
auacuucagaucuccuaug

SEQ ID NO: 1204 - RNA, 19 nt, Artificial Sequence
  Synthetic
aauacauucuuagccagga

SEQ ID NO: 1205 - RNA, 19 nt, Artificial Sequence
  Synthetic
ucaaacuaugguuucuuaa

SEQ ID NO: 1206 - RNA, 19 nt, Artificial Sequence
  Synthetic
gauugauaaauauagauaa

SEQ ID NO: 1207 - RNA, 19 nt, Artificial Sequence
  Synthetic
aaauauacauuaaaaauaa

SEQ ID NO: 1208 - RNA, 19 nt, Artificial Sequence
  Synthetic
caccagaaacccuagaaaa

SEQ ID NO: 1209 - RNA, 19 nt, Artificial Sequence
  Synthetic
auauacuaaccaauccggu

SEQ ID NO: 1210 - RNA, 19 nt, Artificial Sequence
  Synthetic
uuaaauguaaugacaaaaa

SEQ ID NO: 1211 - RNA, 19 nt, Artificial Sequence
  Synthetic
auuuauuuccuacgguugu

SEQ ID NO: 1212 - RNA, 19 nt, Artificial Sequence
  Synthetic
ugauugauaaaauuauaga

SEQ ID NO: 1213 - RNA, 19 nt, Artificial Sequence
  Synthetic
ccaaaucuaaccaacuuua

SEQ ID NO: 1214 - RNA, 19 nt, Artificial Sequence
  Synthetic
acacuacuacuucucauca

SEQ ID NO: 1215 - RNA, 19 nt, Artificial Sequence
  Synthetic
aaauaccuuuagugcacaa

SEQ ID NO: 1216 - RNA, 19 nt, Artificial Sequence
  Synthetic
cugaauugccuguaacagu

SEQ ID NO: 1217 - RNA, 19 nt, Artificial Sequence
  Synthetic
uaauagaguggagcaagca

SEQ ID NO: 1218 - RNA, 19 nt, Artificial Sequence
  Synthetic
auaucgauuucaaauuaga

SEQ ID NO: 1219 - RNA, 19 nt, Artificial Sequence
  Synthetic
gcaguaaguuaaagggguc

SEQ ID NO: 1220 - RNA, 19 nt, Artificial Sequence
  Synthetic
auguguucccaguauuuaa

SEQ ID NO: 1221 - RNA, 19 nt, Artificial Sequence
  Synthetic
cuaagaaggcugauaaaga

SEQ ID NO: 1222 - RNA, 19 nt, Artificial Sequence
  Synthetic
uagcaggacguaaugaagu

SEQ ID NO: 1223 - RNA, 19 nt, Artificial Sequence
  Synthetic
auaaucauuuauauauggu

SEQ ID NO: 1224 - RNA, 19 nt, Artificial Sequence
  Synthetic
aucuaagugaauuguuaaa

SEQ ID NO: 1225 - RNA, 19 nt, Artificial Sequence
  Synthetic
aaaucacagguaguuuguu

SEQ ID NO: 1226 - RNA, 19 nt, Artificial Sequence
  Synthetic
aauaaugaauaaaaaucuu

SEQ ID NO: 1227 - RNA, 19 nt, Artificial Sequence
  Synthetic
uauauuaaaaauucccaua

SEQ ID NO: 1228 - RNA, 19 nt, Artificial Sequence
  Synthetic
agcuacacacuaacacugu

SEQ ID NO: 1229 - RNA, 19 nt, Artificial Sequence
  Synthetic
aauuuuuuaauaacuuuua

SEQ ID NO: 1230 - RNA, 19 nt, Artificial Sequence
  Synthetic
agugaacuaauccuaaaau

SEQ ID NO: 1231 - RNA, 19 nt, Artificial Sequence
  Synthetic
aggaauaaauuuaaaucca

SEQ ID NO: 1232 - RNA, 19 nt, Artificial Sequence
  Synthetic
aaaucuaauugguuuauau

SEQ ID NO: 1233 - RNA, 19 nt, Artificial Sequence
  Synthetic
uguauauuaacuaaacuac

SEQ ID NO: 1234 - RNA, 19 nt, Artificial Sequence
  Synthetic
auacauuuaacuaaugcau

SEQ ID NO: 1235 - RNA, 19 nt, Artificial Sequence
  Synthetic
ggcauuguauuugugcaug

SEQ ID NO: 1236 - RNA, 19 nt, Artificial Sequence
  Synthetic
auuguagugaaauccaauu

SEQ ID NO: 1237 - RNA, 19 nt, Artificial Sequence
  Synthetic
uucacaacaaugccagugu

SEQ ID NO: 1238 - RNA, 19 nt, Artificial Sequence
  Synthetic
uuacaaaauggagguuaua

SEQ ID NO: 1239 - RNA, 19 nt, Artificial Sequence
  Synthetic
uuaacacacugcucucaac

SEQ ID NO: 1240 - RNA, 19 nt, Artificial Sequence
  Synthetic
ccuaauggccuaauagaug

SEQ ID NO: 1241 - RNA, 19 nt, Artificial Sequence
  Synthetic
caagauauuaaugggaaag

SEQ ID NO: 1242 - RNA, 19 nt, Artificial Sequence
  Synthetic
aaaaauggggcaaauaaaa

SEQ ID NO: 1243 - RNA, 19 nt, Artificial Sequence
  Synthetic
acaucauggaaaaguuugc

SEQ ID NO: 1244 - RNA, 19 nt, Artificial Sequence
  Synthetic
uaagagaagacaugauaga

SEQ ID NO: 1245 - RNA, 19 nt, Artificial Sequence
  Synthetic
cacccaauggaccuucauu

SEQ ID NO: 1246 - RNA, 19 nt, Artificial Sequence
  Synthetic
aacacgccaggcaaaauca

SEQ ID NO: 1247 - RNA, 19 nt, Artificial Sequence
  Synthetic
ugaacaaacucugugaaua

SEQ ID NO: 1248 - RNA, 19 nt, Artificial Sequence
  Synthetic
accaccaagacacuagaaa

SEQ ID NO: 1249 - RNA, 19 nt, Artificial Sequence
  Synthetic
uuaucaaacaacaugcagu

SEQ ID NO: 1250 - RNA, 19 nt, Artificial Sequence
  Synthetic
guguaauggaacagacgcu

SEQ ID NO: 1251 - RNA, 19 nt, Artificial Sequence
  Synthetic
gaacaaaaucaaaagugcu

SEQ ID NO: 1252 - RNA, 19 nt, Artificial Sequence
  Synthetic
gaaacugcacacauccccu

SEQ ID NO: 1253 - RNA, 19 nt, Artificial Sequence
  Synthetic
gguugacacugugucugua

SEQ ID NO: 1254 - RNA, 19 nt, Artificial Sequence
  Synthetic
ggauaaaagcaucgauacu

SEQ ID NO: 1255 - RNA, 19 nt, Artificial Sequence
  Synthetic
uuuaucagaaauaagugga

SEQ ID NO: 1256 - RNA, 19 nt, Artificial Sequence
  Synthetic
ugucuaaguaucauaaagg

SEQ ID NO: 1257 - RNA, 19 nt, Artificial Sequence
  Synthetic
ucuugacauggaaaaauau

SEQ ID NO: 1258 - RNA, 19 nt, Artificial Sequence
  Synthetic
guguacaaucucuauuuuu

SEQ ID NO: 1259 - RNA, 19 nt, Artificial Sequence
  Synthetic
ucugguuacauuuagcuau

SEQ ID NO: 1260 - RNA, 19 nt, Artificial Sequence
  Synthetic
uggcaguuacugagguuuu

SEQ ID NO: 1261 - RNA, 19 nt, Artificial Sequence
  Synthetic
gcauaggaauucuuggguu

SEQ ID NO: 1262 - RNA, 19 nt, Artificial Sequence
  Synthetic
uuauuaaaucgccuacaau

SEQ ID NO: 1263 - RNA, 19 nt, Artificial Sequence
  Synthetic
uuauaauuaaagauccuaa

SEQ ID NO: 1264 - RNA, 19 nt, Artificial Sequence
  Synthetic
uggaacuucaucccgauau

SEQ ID NO: 1265 - RNA, 19 nt, Artificial Sequence
  Synthetic
gucugaaggauugcaauga

SEQ ID NO: 1266 - RNA, 19 nt, Artificial Sequence
  Synthetic
uauucaauuauaguuauuu

SEQ ID NO: 1267 - RNA, 19 nt, Artificial Sequence
  Synthetic
uaaaauuaaaaauuauaua

SEQ ID NO: 1268 - RNA, 19 nt, Artificial Sequence
  Synthetic
cuuauuugccccauuuuuu

SEQ ID NO: 1269 - RNA, 19 nt, Artificial Sequence
  Synthetic
ucuuauuugccccauuuuu

SEQ ID NO: 1270 - RNA, 19 nt, Artificial Sequence
  Synthetic
uucuuauuugccccauuuu

SEQ ID NO: 1271 - RNA, 19 nt, Artificial Sequence
  Synthetic
auucuuauuugccccauuu

SEQ ID NO: 1272 - RNA, 19 nt, Artificial Sequence
  Synthetic
aauucuuauuugccccauu

SEQ ID NO: 1273 - RNA, 19 nt, Artificial Sequence
  Synthetic
aaauucuuauuugccccau

SEQ ID NO: 1274 - RNA, 19 nt, Artificial Sequence
  Synthetic
caaauucuuauuugcccca

SEQ ID NO: 1275 - RNA, 19 nt, Artificial Sequence
  Synthetic
ucaaauucuuauuugcccc

SEQ ID NO: 1276 - RNA, 19 nt, Artificial Sequence
  Synthetic
aucaaauucuuauuugccc

SEQ ID NO: 1277 - RNA, 19 nt, Artificial Sequence
  Synthetic
uaucaaauucuuauuugcc

SEQ ID NO: 1278 - RNA, 19 nt, Artificial Sequence
  Synthetic
uuaucaaauucuuauuugc

SEQ ID NO: 1279 - RNA, 19 nt, Artificial Sequence
  Synthetic
cuuaucaaauucuuauuug

SEQ ID NO: 1280 - RNA, 19 nt, Artificial Sequence
  Synthetic
acuuaucaaauucuuauuu

SEQ ID NO: 1281 - RNA, 19 nt, Artificial Sequence
  Synthetic
uuuuuaacaaugcuacuuc

SEQ ID NO: 1282 - RNA, 19 nt, Artificial Sequence
  Synthetic
auuuuuaacaaugcuacuu

SEQ ID NO: 1283 - RNA, 19 nt, Artificial Sequence
  Synthetic
uauuuuuaacaaugcuacu

SEQ ID NO: 1284 - RNA, 19 nt, Artificial Sequence
  Synthetic
uuauuuuuaacaaugcuac

SEQ ID NO: 1285 - RNA, 19 nt, Artificial Sequence
  Synthetic
guuauuuuuaacaaugcua

SEQ ID NO: 1286 - RNA, 19 nt, Artificial Sequence
  Synthetic
uguuauuuuuaacaaugcu

SEQ ID NO: 1287 - RNA, 19 nt, Artificial Sequence
  Synthetic
auguuauuuuuaacaaugc

SEQ ID NO: 1288 - RNA, 19 nt, Artificial Sequence
  Synthetic
cauguuauuuuuaacaaug

SEQ ID NO: 1289 - RNA, 19 nt, Artificial Sequence
  Synthetic
gucuuucaucaaguuuucu

SEQ ID NO: 1290 - RNA, 19 nt, Artificial Sequence
  Synthetic
ugucuuucaucaaguuuuc

SEQ ID NO: 1291 - RNA, 19 nt, Artificial Sequence
  Synthetic
uuguaggcuuaaugccaau

SEQ ID NO: 1292 - RNA, 19 nt, Artificial Sequence
  Synthetic
uuuguaggcuuaaugccaa

SEQ ID NO: 1293 - RNA, 19 nt, Artificial Sequence
  Synthetic
ugacuuugcuaagagccau

SEQ ID NO: 1294 - RNA, 19 nt, Artificial Sequence
  Synthetic
uugacuuugcuaagagcca

SEQ ID NO: 1295 - RNA, 19 nt, Artificial Sequence
  Synthetic
cuugacuuugcuaagagcc

SEQ ID NO: 1296 - RNA, 19 nt, Artificial Sequence
  Synthetic
acuugacuuugcuaagagc

SEQ ID NO: 1297 - RNA, 19 nt, Artificial Sequence
  Synthetic
aacuugacuuugcuaagag

SEQ ID NO: 1298 - RNA, 19 nt, Artificial Sequence
  Synthetic
cauauaacauaccuauuaa

SEQ ID NO: 1299 - RNA, 19 nt, Artificial Sequence
  Synthetic
gcauauaacauaccuauua

SEQ ID NO: 1300 - RNA, 19 nt, Artificial Sequence
  Synthetic
uucuagauucuaucucaau

SEQ ID NO: 1301 - RNA, 19 nt, Artificial Sequence
  Synthetic
uuucuagauucuaucucaa

SEQ ID NO: 1302 - RNA, 19 nt, Artificial Sequence
  Synthetic
uuagcauuuuuuuguagga

SEQ ID NO: 1303 - RNA, 19 nt, Artificial Sequence
  Synthetic
uuuagcauuuuuuuguagg

SEQ ID NO: 1304 - RNA, 19 nt, Artificial Sequence
  Synthetic
uuuuagcauuuuuuuguag

SEQ ID NO: 1305 - RNA, 19 nt, Artificial Sequence
  Synthetic
cuuuuagcauuuuuuugua

SEQ ID NO: 1306 - RNA, 19 nt, Artificial Sequence
  Synthetic
ucuuuuagcauuuuuuugu

SEQ ID NO: 1307 - RNA, 19 nt, Artificial Sequence
  Synthetic
uguucaauauaugguagaa

SEQ ID NO: 1308 - RNA, 19 nt, Artificial Sequence
  Synthetic
uuguucaauauaugguaga

SEQ ID NO: 1309 - RNA, 19 nt, Artificial Sequence
  Synthetic
uuauugauucuaggaauuu

SEQ ID NO: 1310 - RNA, 19 nt, Artificial Sequence
  Synthetic
uuuauugauucuaggaauu

SEQ ID NO: 1311 - RNA, 19 nt, Artificial Sequence
  Synthetic
cuuuauugauucuaggaau

SEQ ID NO: 1312 - RNA, 19 nt, Artificial Sequence
  Synthetic
ccuuuauugauucuaggaa

SEQ ID NO: 1313 - RNA, 19 nt, Artificial Sequence
  Synthetic
cccuuuauugauucuagga

SEQ ID NO: 1314 - RNA, 19 nt, Artificial Sequence
  Synthetic
gcccuuuauugauucuagg

SEQ ID NO: 1315 - RNA, 19 nt, Artificial Sequence
  Synthetic
ugcccuuuauugauucuag

SEQ ID NO: 1316 - RNA, 19 nt, Artificial Sequence
  Synthetic
uugcccuuuauugauucua

SEQ ID NO: 1317 - RNA, 19 nt, Artificial Sequence
  Synthetic
cuucuauaucuauugaguu

SEQ ID NO: 1318 - RNA, 19 nt, Artificial Sequence
  Synthetic
acuucuauaucuauugagu

SEQ ID NO: 1319 - RNA, 19 nt, Artificial Sequence
  Synthetic
uacuucuauaucuauugag

SEQ ID NO: 1320 - RNA, 19 nt, Artificial Sequence
  Synthetic
uuacuucuauaucuauuga

SEQ ID NO: 1321 - RNA, 19 nt, Artificial Sequence
  Synthetic
guuacuucuauaucuauug

SEQ ID NO: 1322 - RNA, 19 nt, Artificial Sequence
  Synthetic
cuucauuguuaucaaaugu

SEQ ID NO: 1323 - RNA, 19 nt, Artificial Sequence
  Synthetic
ucuucauuguuaucaaaug

SEQ ID NO: 1324 - RNA, 19 nt, Artificial Sequence
  Synthetic
uucuucauuguuaucaaau

SEQ ID NO: 1325 - RNA, 19 nt, Artificial Sequence
  Synthetic
cuucuucauuguuaucaaa

SEQ ID NO: 1326 - RNA, 19 nt, Artificial Sequence
  Synthetic
ucuucuucauuguuaucaa

SEQ ID NO: 1327 - RNA, 19 nt, Artificial Sequence
  Synthetic
uucuucuucauuguuauca

SEQ ID NO: 1328 - RNA, 19 nt, Artificial Sequence
  Synthetic
auucuucuucauuguuauc

SEQ ID NO: 1329 - RNA, 19 nt, Artificial Sequence
  Synthetic
gauucuucuucauuguuau

SEQ ID NO: 1330 - RNA, 19 nt, Artificial Sequence
  Synthetic
cacuuaauuuuucaucaau

SEQ ID NO: 1331 - RNA, 19 nt, Artificial Sequence
  Synthetic
ucacuuaauuuuucaucaa

SEQ ID NO: 1332 - RNA, 19 nt, Artificial Sequence
  Synthetic
uucacuuaauuuuucauca

SEQ ID NO: 1333 - RNA, 19 nt, Artificial Sequence
  Synthetic
uuucacuuaauuuuucauc

SEQ ID NO: 1334 - RNA, 19 nt, Artificial Sequence
  Synthetic
auuucacuuaauuuuucau

SEQ ID NO: 1335 - RNA, 19 nt, Artificial Sequence
  Synthetic
uauuucacuuaauuuuuca

SEQ ID NO: 1336 - RNA, 19 nt, Artificial Sequence
  Synthetic
cauuggucauuaaugcuuc

SEQ ID NO: 1337 - RNA, 19 nt, Artificial Sequence
  Synthetic
ucauuggucauuaaugcuu

SEQ ID NO: 1338 - RNA, 19 nt, Artificial Sequence
  Synthetic
uguuuccauauuugcccca

SEQ ID NO: 1339 - RNA, 19 nt, Artificial Sequence
  Synthetic
auguuuccauauuugcccc

SEQ ID NO: 1340 - RNA, 19 nt, Artificial Sequence
  Synthetic
uauguuuccauauuugccc

SEQ ID NO: 1341 - RNA, 19 nt, Artificial Sequence
  Synthetic
guauguuuccauauuugcc

SEQ ID NO: 1342 - RNA, 19 nt, Artificial Sequence
  Synthetic
cguauguuuccauauuugc

SEQ ID NO: 1343 - RNA, 19 nt, Artificial Sequence
  Synthetic
acguauguuuccauauuug

SEQ ID NO: 1344 - RNA, 19 nt, Artificial Sequence
  Synthetic
cacguauguuuccauauuu

SEQ ID NO: 1345 - RNA, 19 nt, Artificial Sequence
  Synthetic
ucacguauguuuccauauu

SEQ ID NO: 1346 - RNA, 19 nt, Artificial Sequence
  Synthetic
uucacguauguuuccauau

SEQ ID NO: 1347 - RNA, 19 nt, Artificial Sequence
  Synthetic
guucacguauguuuccaua

SEQ ID NO: 1348 - RNA, 19 nt, Artificial Sequence
  Synthetic
uguucacguauguuuccau

SEQ ID NO: 1349 - RNA, 19 nt, Artificial Sequence
  Synthetic
uuguucacguauguuucca

SEQ ID NO: 1350 - RNA, 19 nt, Artificial Sequence
  Synthetic
auguggagccuucgugaag

SEQ ID NO: 1351 - RNA, 19 nt, Artificial Sequence
  Synthetic
uauguggagccuucgugaa

SEQ ID NO: 1352 - RNA, 19 nt, Artificial Sequence
  Synthetic
guauguggagccuucguga

SEQ ID NO: 1353 - RNA, 19 nt, Artificial Sequence
  Synthetic
uguauguggagccuucgug

SEQ ID NO: 1354 - RNA, 19 nt, Artificial Sequence
  Synthetic
guguauguggagccuucgu

SEQ ID NO: 1355 - RNA, 19 nt, Artificial Sequence
  Synthetic
uguguauguggagccuucg

SEQ ID NO: 1356 - RNA, 19 nt, Artificial Sequence
  Synthetic
cuguguauguggagccuuc

SEQ ID NO: 1357 - RNA, 19 nt, Artificial Sequence
  Synthetic
gcuguguauguggagccuu

SEQ ID NO: 1358 - RNA, 19 nt, Artificial Sequence
  Synthetic
cuaacacuuugcugguuaa

SEQ ID NO: 1359 - RNA, 19 nt, Artificial Sequence
  Synthetic
ucuaacacuuugcugguua

SEQ ID NO: 1360 - RNA, 19 nt, Artificial Sequence
  Synthetic
uuuucugaucauuuguuau

SEQ ID NO: 1361 - RNA, 19 nt, Artificial Sequence
  Synthetic
uuuuucugaucauuuguua

SEQ ID NO: 1362 - RNA, 19 nt, Artificial Sequence
  Synthetic
ugucacaaaauacucgauu

SEQ ID NO: 1363 - RNA, 19 nt, Artificial Sequence
  Synthetic
gugucacaaaauacucgau

SEQ ID NO: 1364 - RNA, 19 nt, Artificial Sequence
  Synthetic
gagauauugaugcaucaaa

SEQ ID NO: 1365 - RNA, 19 nt, Artificial Sequence
  Synthetic
ugagauauugaugcaucaa

SEQ ID NO: 1366 - RNA, 19 nt, Artificial Sequence
  Synthetic
uugagauauugaugcauca

SEQ ID NO: 1367 - RNA, 19 nt, Artificial Sequence
  Synthetic
cuugagauauugaugcauc

SEQ ID NO: 1368 - RNA, 19 nt, Artificial Sequence
  Synthetic
acuugagauauugaugcau

SEQ ID NO: 1369 - RNA, 19 nt, Artificial Sequence
  Synthetic
gacuugagauauugaugca

SEQ ID NO: 1370 - RNA, 19 nt, Artificial Sequence
  Synthetic
ugacuugagauauugaugc

SEQ ID NO: 1371 - RNA, 19 nt, Artificial Sequence
  Synthetic
uugacuugagauauugaug

SEQ ID NO: 1372 - RNA, 19 nt, Artificial Sequence
  Synthetic
cucucuagcacuccaacua

SEQ ID NO: 1373 - RNA, 19 nt, Artificial Sequence
  Synthetic
acucucuagcacuccaacu

SEQ ID NO: 1374 - RNA, 19 nt, Artificial Sequence
  Synthetic
aacucucuagcacuccaac

SEQ ID NO: 1375 - RNA, 19 nt, Artificial Sequence
  Synthetic
uaacucucuagcacuccaa

SEQ ID NO: 1376 - RNA, 19 nt, Artificial Sequence
  Synthetic
caacacaugcugauuguuu

SEQ ID NO: 1377 - RNA, 19 nt, Artificial Sequence
  Synthetic
gcaacacaugcugauuguu

SEQ ID NO: 1378 - RNA, 19 nt, Artificial Sequence
  Synthetic
uauuguacacucuuaucuu

SEQ ID NO: 1379 - RNA, 19 nt, Artificial Sequence
  Synthetic
guauuguacacucuuaucu

SEQ ID NO: 1380 - RNA, 19 nt, Artificial Sequence
  Synthetic
aguauuguacacucuuauc

SEQ ID NO: 1381 - RNA, 19 nt, Artificial Sequence
  Synthetic
caguauuguacacucuuau

SEQ ID NO: 1382 - RNA, 19 nt, Artificial Sequence
  Synthetic
acaguauuguacacucuua

SEQ ID NO: 1383 - RNA, 19 nt, Artificial Sequence
  Synthetic
uaugacacuaauauauaua

SEQ ID NO: 1384 - RNA, 19 nt, Artificial Sequence
  Synthetic
uuaugacacuaauauauau

SEQ ID NO: 1385 - RNA, 19 nt, Artificial Sequence
  Synthetic
ugggauccauuuuguccca

SEQ ID NO: 1386 - RNA, 19 nt, Artificial Sequence
  Synthetic
augggauccauuuuguccc

SEQ ID NO: 1387 - RNA, 19 nt, Artificial Sequence
  Synthetic
aaugggauccauuuugucc

SEQ ID NO: 1388 - RNA, 19 nt, Artificial Sequence
  Synthetic
uaaugggauccauuuuguc

SEQ ID NO: 1389 - RNA, 19 nt, Artificial Sequence
  Synthetic
auaaugggauccauuuugu

SEQ ID NO: 1390 - RNA, 19 nt, Artificial Sequence
  Synthetic
aauaaugggauccauuuug

SEQ ID NO: 1391 - RNA, 19 nt, Artificial Sequence
  Synthetic
uaauaaugggauccauuuu

SEQ ID NO: 1392 - RNA, 19 nt, Artificial Sequence
  Synthetic
uuaauaaugggauccauuu

SEQ ID NO: 1393 - RNA, 19 nt, Artificial Sequence
  Synthetic
auuaauaaugggauccauu

SEQ ID NO: 1394 - RNA, 19 nt, Artificial Sequence
  Synthetic
cauuaauaaugggauccau

SEQ ID NO: 1395 - RNA, 19 nt, Artificial Sequence
  Synthetic
ccauuaauaaugggaucca

SEQ ID NO: 1396 - RNA, 19 nt, Artificial Sequence
  Synthetic
uccauuaauaaugggaucc

SEQ ID NO: 1397 - RNA, 19 nt, Artificial Sequence
  Synthetic
uuccauuaauaaugggauc

SEQ ID NO: 1398 - RNA, 19 nt, Artificial Sequence
  Synthetic
uuuccauuaauaaugggau

SEQ ID NO: 1399 - RNA, 19 nt, Artificial Sequence
  Synthetic
uuugucuacuaauuaaguu

SEQ ID NO: 1400 - RNA, 19 nt, Artificial Sequence
  Synthetic
augucauaaguaaugacug

SEQ ID NO: 1401 - RNA, 19 nt, Artificial Sequence
  Synthetic
uaugucauaaguaaugacu

SEQ ID NO: 1402 - RNA, 19 nt, Artificial Sequence
  Synthetic
ucaagaguguuguuuugau

SEQ ID NO: 1403 - RNA, 19 nt, Artificial Sequence
  Synthetic
uucaagaguguuguuuuga

SEQ ID NO: 1404 - RNA, 19 nt, Artificial Sequence
  Synthetic
uuaaccaugauggaggaug

SEQ ID NO: 1405 - RNA, 19 nt, Artificial Sequence
  Synthetic
auuaaccaugauggaggau

SEQ ID NO: 1406 - RNA, 19 nt, Artificial Sequence
  Synthetic
uauuaaccaugauggagga

SEQ ID NO: 1407 - RNA, 19 nt, Artificial Sequence
  Synthetic
guauuaaccaugauggagg

SEQ ID NO: 1408 - RNA, 19 nt, Artificial Sequence
  Synthetic
uguauuaaccaugauggag

SEQ ID NO: 1409 - RNA, 19 nt, Artificial Sequence
  Synthetic
cuaagcuuuuauuuaaugu

SEQ ID NO: 1410 - RNA, 19 nt, Artificial Sequence
  Synthetic
ccuaagcuuuuauuuaaug

SEQ ID NO: 1411 - RNA, 19 nt, Artificial Sequence
  Synthetic
acauaauaaaucccucuac

SEQ ID NO: 1412 - RNA, 19 nt, Artificial Sequence
  Synthetic
gacauaauaaaucccucua

SEQ ID NO: 1413 - RNA, 19 nt, Artificial Sequence
  Synthetic
agacauaauaaaucccucu

SEQ ID NO: 1414 - RNA, 19 nt, Artificial Sequence
  Synthetic
auugaucuucuucuguuau

SEQ ID NO: 1415 - RNA, 19 nt, Artificial Sequence
  Synthetic
aauugaucuucuucuguua

SEQ ID NO: 1416 - RNA, 19 nt, Artificial Sequence
  Synthetic
agauccacuuuuuuaggca

SEQ ID NO: 1417 - RNA, 19 nt, Artificial Sequence
  Synthetic
aagauccacuuuuuuaggc

SEQ ID NO: 1418 - RNA, 19 nt, Artificial Sequence
  Synthetic
caagauccacuuuuuuagg

SEQ ID NO: 1419 - RNA, 19 nt, Artificial Sequence
  Synthetic
ucaagauccacuuuuuuag

SEQ ID NO: 1420 - RNA, 19 nt, Artificial Sequence
  Synthetic
uucaagauccacuuuuuua

SEQ ID NO: 1421 - RNA, 19 nt, Artificial Sequence
  Synthetic
uuucaagauccacuuuuuu

SEQ ID NO: 1422 - RNA, 19 nt, Artificial Sequence
  Synthetic
auuucaagauccacuuuuu

SEQ ID NO: 1423 - RNA, 19 nt, Artificial Sequence
  Synthetic
cauuucaagauccacuuuu

SEQ ID NO: 1424 - RNA, 19 nt, Artificial Sequence
  Synthetic
ucauuucaagauccacuuu

SEQ ID NO: 1425 - RNA, 19 nt, Artificial Sequence
  Synthetic
aucauuucaagauccacuu

SEQ ID NO: 1426 - RNA, 19 nt, Artificial Sequence
  Synthetic
acauucuaccuacacugag

SEQ ID NO: 1427 - RNA, 19 nt, Artificial Sequence
  Synthetic
aacauucuaccuacacuga

SEQ ID NO: 1428 - RNA, 19 nt, Artificial Sequence
  Synthetic
aaacauucuaccuacacug

SEQ ID NO: 1429 - RNA, 19 nt, Artificial Sequence
  Synthetic
caaacauucuaccuacacu

SEQ ID NO: 1430 - RNA, 19 nt, Artificial Sequence
  Synthetic
gcaaacauucuaccuacac

SEQ ID NO: 1431 - RNA, 19 nt, Artificial Sequence
  Synthetic
cuagaucaccauaucuugu

SEQ ID NO: 1432 - RNA, 19 nt, Artificial Sequence
  Synthetic
ucuagaucaccauaucuug

SEQ ID NO: 1433 - RNA, 19 nt, Artificial Sequence
  Synthetic
augcuugauugaauuugcu

SEQ ID NO: 1434 - RNA, 19 nt, Artificial Sequence
  Synthetic
aaugcuugauugaauuugc

SEQ ID NO: 1435 - RNA, 19 nt, Artificial Sequence
  Synthetic
aaaugcuugauugaauuug

SEQ ID NO: 1436 - RNA, 19 nt, Artificial Sequence
  Synthetic
auaauccacuuuguucauc

SEQ ID NO: 1437 - RNA, 19 nt, Artificial Sequence
  Synthetic
uauaauccacuuuguucau

SEQ ID NO: 1438 - RNA, 19 nt, Artificial Sequence
  Synthetic
aauauuaaacugcauaaua

SEQ ID NO: 1439 - RNA, 19 nt, Artificial Sequence
  Synthetic
aaauauuaaacugcauaau

SEQ ID NO: 1440 - RNA, 19 nt, Artificial Sequence
  Synthetic
uaaauauuaaacugcauaa

SEQ ID NO: 1441 - RNA, 19 nt, Artificial Sequence
  Synthetic
cuaaauauuaaacugcaua

SEQ ID NO: 1442 - RNA, 19 nt, Artificial Sequence
  Synthetic
guucuauauuuugcauaau

SEQ ID NO: 1443 - RNA, 19 nt, Artificial Sequence
  Synthetic
gguucuauauuuugcauaa

SEQ ID NO: 1444 - RNA, 19 nt, Artificial Sequence
  Synthetic
cuuucauaaacaacucuua

SEQ ID NO: 1445 - RNA, 19 nt, Artificial Sequence
  Synthetic
acuuucauaaacaacucuu

SEQ ID NO: 1446 - RNA, 19 nt, Artificial Sequence
  Synthetic
cuggcauuguuuuuuucuc

SEQ ID NO: 1447 - RNA, 19 nt, Artificial Sequence
  Synthetic
acuggcauuguuuuuuucu

SEQ ID NO: 1448 - RNA, 19 nt, Artificial Sequence
  Synthetic
guucuuccaugaauucauc

SEQ ID NO: 1449 - RNA, 19 nt, Artificial Sequence
  Synthetic
aguucuuccaugaauucau

SEQ ID NO: 1450 - RNA, 19 nt, Artificial Sequence
  Synthetic
augcagggaauucacaugg

SEQ ID NO: 1451 - RNA, 19 nt, Artificial Sequence
  Synthetic
gaugcagggaauucacaug

SEQ ID NO: 1452 - RNA, 19 nt, Artificial Sequence
  Synthetic
ugaugcagggaauucacau

SEQ ID NO: 1453 - RNA, 19 nt, Artificial Sequence
  Synthetic
uugaugcagggaauucaca

SEQ ID NO: 1454 - RNA, 19 nt, Artificial Sequence
  Synthetic
auugaugcagggaauucac

SEQ ID NO: 1455 - RNA, 19 nt, Artificial Sequence
  Synthetic
uauugaugcagggaauuca

SEQ ID NO: 1456 - RNA, 19 nt, Artificial Sequence
  Synthetic
guauugaugcagggaauuc

SEQ ID NO: 1457 - RNA, 19 nt, Artificial Sequence
  Synthetic
gguauugaugcagggaauu

SEQ ID NO: 1458 - RNA, 19 nt, Artificial Sequence
  Synthetic
ugguauugaugcagggaau

SEQ ID NO: 1459 - RNA, 19 nt, Artificial Sequence
  Synthetic
cugguauugaugcagggaa

SEQ ID NO: 1460 - RNA, 19 nt, Artificial Sequence
  Synthetic
gcugguauugaugcaggga

SEQ ID NO: 1461 - RNA, 19 nt, Artificial Sequence
  Synthetic
agcugguauugaugcaggg

SEQ ID NO: 1462 - RNA, 19 nt, Artificial Sequence
  Synthetic
aagcugguauugaugcagg

SEQ ID NO: 1463 - RNA, 19 nt, Artificial Sequence
  Synthetic
uaagcugguauugaugcag

SEQ ID NO: 1464 - RNA, 19 nt, Artificial Sequence
  Synthetic
auaagcugguauugaugca

SEQ ID NO: 1465 - RNA, 19 nt, Artificial Sequence
  Synthetic
uauaagcugguauugaugc

SEQ ID NO: 1466 - RNA, 19 nt, Artificial Sequence
  Synthetic
cuauaagcugguauugaug

SEQ ID NO: 1467 - RNA, 19 nt, Artificial Sequence
  Synthetic
ucuauaagcugguauugau

SEQ ID NO: 1468 - RNA, 19 nt, Artificial Sequence
  Synthetic
uucuauaagcugguauuga

SEQ ID NO: 1469 - RNA, 19 nt, Artificial Sequence
  Synthetic
guucuauaagcugguauug

SEQ ID NO: 1470 - RNA, 19 nt, Artificial Sequence
  Synthetic
ccauacuuuucuguuaaua

SEQ ID NO: 1471 - RNA, 19 nt, Artificial Sequence
  Synthetic
gcuguuuuuguaucacuug

SEQ ID NO: 1472 - RNA, 19 nt, Artificial Sequence
  Synthetic
ugcuguuuuuguaucacuu

SEQ ID NO: 1473 - RNA, 19 nt, Artificial Sequence
  Synthetic
cuaaauuaguacuuaaaau

SEQ ID NO: 1474 - RNA, 19 nt, Artificial Sequence
  Synthetic
gcuaaauuaguacuuaaaa

SEQ ID NO: 1475 - RNA, 19 nt, Artificial Sequence
  Synthetic
agcuaaauuaguacuuaaa

SEQ ID NO: 1476 - RNA, 19 nt, Artificial Sequence
  Synthetic
cagcuaaauuaguacuuaa

SEQ ID NO: 1477 - RNA, 19 nt, Artificial Sequence
  Synthetic
ccagcuaaauuaguacuua

SEQ ID NO: 1478 - RNA, 19 nt, Artificial Sequence
  Synthetic
uccagcuaaauuaguacuu

SEQ ID NO: 1479 - RNA, 19 nt, Artificial Sequence
  Synthetic
guccagcuaaauuaguacu

SEQ ID NO: 1480 - RNA, 19 nt, Artificial Sequence
  Synthetic
uguccagcuaaauuaguac

SEQ ID NO: 1481 - RNA, 19 nt, Artificial Sequence
  Synthetic
auguccagcuaaauuagua

SEQ ID NO: 1482 - RNA, 19 nt, Artificial Sequence
  Synthetic
aauguccagcuaaauuagu

SEQ ID NO: 1483 - RNA, 19 nt, Artificial Sequence
  Synthetic
caauguccagcuaaauuag

SEQ ID NO: 1484 - RNA, 19 nt, Artificial Sequence
  Synthetic
ccaauguccagcuaaauua

SEQ ID NO: 1485 - RNA, 19 nt, Artificial Sequence
  Synthetic
uccaauguccagcuaaauu

SEQ ID NO: 1486 - RNA, 19 nt, Artificial Sequence
  Synthetic
auccaauguccagcuaaau

SEQ ID NO: 1487 - RNA, 19 nt, Artificial Sequence
  Synthetic
aauccaauguccagcuaaa

SEQ ID NO: 1488 - RNA, 19 nt, Artificial Sequence
  Synthetic
gaauccaauguccagcuaa

SEQ ID NO: 1489 - RNA, 19 nt, Artificial Sequence
  Synthetic
agaauccaauguccagcua

SEQ ID NO: 1490 - RNA, 19 nt, Artificial Sequence
  Synthetic
aaucuuuuucaaaaauacc

SEQ ID NO: 1491 - RNA, 19 nt, Artificial Sequence
  Synthetic
caaucuuuuucaaaaauac

SEQ ID NO: 1492 - RNA, 19 nt, Artificial Sequence
  Synthetic
ccaaucuuuuucaaaaaua

SEQ ID NO: 1493 - RNA, 19 nt, Artificial Sequence
  Synthetic
cccaaucuuuuucaaaaau

SEQ ID NO: 1494 - RNA, 19 nt, Artificial Sequence
  Synthetic
ccccaaucuuuuucaaaaa

SEQ ID NO: 1495 - RNA, 19 nt, Artificial Sequence
  Synthetic
uccccaaucuuuuucaaaa

SEQ ID NO: 1496 - RNA, 19 nt, Artificial Sequence
  Synthetic
cuccccaaucuuuuucaaa

SEQ ID NO: 1497 - RNA, 19 nt, Artificial Sequence
  Synthetic
ucuccccaaucuuuuucaa

SEQ ID NO: 1498 - RNA, 19 nt, Artificial Sequence
  Synthetic
cucuccccaaucuuuuuca

SEQ ID NO: 1499 - RNA, 19 nt, Artificial Sequence
  Synthetic
ccucuccccaaucuuuuuc

SEQ ID NO: 1500 - RNA, 19 nt, Artificial Sequence
  Synthetic
cccucuccccaaucuuuuu

SEQ ID NO: 1501 - RNA, 19 nt, Artificial Sequence
  Synthetic
uguuaacaacccaagggca

SEQ ID NO: 1502 - RNA, 19 nt, Artificial Sequence
  Synthetic
auguuaacaacccaagggc

SEQ ID NO: 1503 - RNA, 19 nt, Artificial Sequence
  Synthetic
uauguuaacaacccaaggg

SEQ ID NO: 1504 - RNA, 19 nt, Artificial Sequence
  Synthetic
cuauguuaacaacccaagg

SEQ ID NO: 1505 - RNA, 19 nt, Artificial Sequence
  Synthetic
ucuauguuaacaacccaag

SEQ ID NO: 1506 - RNA, 19 nt, Artificial Sequence
  Synthetic
aucuauguuaacaacccaa

SEQ ID NO: 1507 - RNA, 19 nt, Artificial Sequence
  Synthetic
aaucuauguuaacaaccca

SEQ ID NO: 1508 - RNA, 19 nt, Artificial Sequence
  Synthetic
uaaucuauguuaacaaccc

SEQ ID NO: 1509 - RNA, 19 nt, Artificial Sequence
  Synthetic
auaaucuauguuaacaacc

SEQ ID NO: 1510 - RNA, 19 nt, Artificial Sequence
  Synthetic
gauaaucuauguuaacaac

SEQ ID NO: 1511 - RNA, 19 nt, Artificial Sequence
  Synthetic
ugauaaucuauguuaacaa

SEQ ID NO: 1512 - RNA, 19 nt, Artificial Sequence
  Synthetic
aauucaucauugaauuugu

SEQ ID NO: 1513 - RNA, 19 nt, Artificial Sequence
  Synthetic
aaauucaucauugaauuug

SEQ ID NO: 1514 - RNA, 19 nt, Artificial Sequence
  Synthetic
aaaauucaucauugaauuu

SEQ ID NO: 1515 - RNA, 19 nt, Artificial Sequence
  Synthetic
uaaaauucaucauugaauu

SEQ ID NO: 1516 - RNA, 19 nt, Artificial Sequence
  Synthetic
gaugccaaggaagcaugca

SEQ ID NO: 1517 - RNA, 19 nt, Artificial Sequence
  Synthetic
ugaugccaaggaagcaugc

SEQ ID NO: 1518 - RNA, 19 nt, Artificial Sequence
  Synthetic
augaugccaaggaagcaug

SEQ ID NO: 1519 - RNA, 19 nt, Artificial Sequence
  Synthetic
uuaaaauauacucuauacu

SEQ ID NO: 1520 - RNA, 19 nt, Artificial Sequence
  Synthetic
uuuaaaauauacucuauac

SEQ ID NO: 1521 - RNA, 19 nt, Artificial Sequence
  Synthetic
uuuuaaaauauacucuaua

SEQ ID NO: 1522 - RNA, 19 nt, Artificial Sequence
  Synthetic
cuuuuaaaauauacucuau

SEQ ID NO: 1523 - RNA, 19 nt, Artificial Sequence
  Synthetic
ucuuuuaaaauauacucua

SEQ ID NO: 1524 - RNA, 19 nt, Artificial Sequence
  Synthetic
accuaugaaugcuauacaa

SEQ ID NO: 1525 - RNA, 19 nt, Artificial Sequence
  Synthetic
caccuaugaaugcuauaca

SEQ ID NO: 1526 - RNA, 19 nt, Artificial Sequence
  Synthetic
ucaccuaugaaugcuauac

SEQ ID NO: 1527 - RNA, 19 nt, Artificial Sequence
  Synthetic
uucaccuaugaaugcuaua

SEQ ID NO: 1528 - RNA, 19 nt, Artificial Sequence
  Synthetic
cuucaccuaugaaugcuau

SEQ ID NO: 1529 - RNA, 19 nt, Artificial Sequence
  Synthetic
ccuucaccuaugaaugcua

SEQ ID NO: 1530 - RNA, 19 nt, Artificial Sequence
  Synthetic
uccuucaccuaugaaugcu

SEQ ID NO: 1531 - RNA, 19 nt, Artificial Sequence
  Synthetic
cuccuucaccuaugaaugc

SEQ ID NO: 1532 - RNA, 19 nt, Artificial Sequence
  Synthetic
gcuccuucaccuaugaaug

SEQ ID NO: 1533 - RNA, 19 nt, Artificial Sequence
  Synthetic
caucuguagcaggaauggu

SEQ ID NO: 1534 - RNA, 19 nt, Artificial Sequence
  Synthetic
gcaucuguagcaggaaugg

SEQ ID NO: 1535 - RNA, 19 nt, Artificial Sequence
  Synthetic
ugcaucuguagcaggaaug

SEQ ID NO: 1536 - RNA, 19 nt, Artificial Sequence
  Synthetic
uugcaucuguagcaggaau

SEQ ID NO: 1537 - RNA, 19 nt, Artificial Sequence
  Synthetic
guugcaucuguagcaggaa

SEQ ID NO: 1538 - RNA, 19 nt, Artificial Sequence
  Synthetic
aauaagaccaaugaauguu

SEQ ID NO: 1539 - RNA, 19 nt, Artificial Sequence
  Synthetic
aaauaagaccaaugaaugu

SEQ ID NO: 1540 - RNA, 19 nt, Artificial Sequence
  Synthetic
uaaauaagaccaaugaaug

SEQ ID NO: 1541 - RNA, 19 nt, Artificial Sequence
  Synthetic
guaaauaagaccaaugaau

SEQ ID NO: 1542 - RNA, 19 nt, Artificial Sequence
  Synthetic
uguaaauaagaccaaugaa

SEQ ID NO: 1543 - RNA, 19 nt, Artificial Sequence
  Synthetic
auguaaauaagaccaauga

SEQ ID NO: 1544 - RNA, 19 nt, Artificial Sequence
  Synthetic
uauguaaauaagaccaaug

SEQ ID NO: 1545 - RNA, 19 nt, Artificial Sequence
  Synthetic
auauguaaauaagaccaau

SEQ ID NO: 1546 - RNA, 19 nt, Artificial Sequence
  Synthetic
uauauguaaauaagaccaa

SEQ ID NO: 1547 - RNA, 19 nt, Artificial Sequence
  Synthetic
uuauauguaaauaagacca

SEQ ID NO: 1548 - RNA, 19 nt, Artificial Sequence
  Synthetic
uuuauauguaaauaagacc

SEQ ID NO: 1549 - RNA, 19 nt, Artificial Sequence
  Synthetic
aucuugagcaugauauuuu

SEQ ID NO: 1550 - RNA, 19 nt, Artificial Sequence
  Synthetic
caucuugagcaugauauuu

SEQ ID NO: 1551 - RNA, 19 nt, Artificial Sequence
  Synthetic
ucaucuugagcaugauauu

SEQ ID NO: 1552 - RNA, 19 nt, Artificial Sequence
  Synthetic
aucaucuugagcaugauau

SEQ ID NO: 1553 - RNA, 19 nt, Artificial Sequence
  Synthetic
uaucaucuugagcaugaua

SEQ ID NO: 1554 - RNA, 19 nt, Artificial Sequence
  Synthetic
auaucaucuugagcaugau

SEQ ID NO: 1555 - RNA, 19 nt, Artificial Sequence
  Synthetic
uuguaaggacuaaguaaac

SEQ ID NO: 1556 - RNA, 19 nt, Artificial Sequence
  Synthetic
auuguaaggacuaaguaaa

SEQ ID NO: 1557 - RNA, 19 nt, Artificial Sequence
  Synthetic
uauuguaaggacuaaguaa

SEQ ID NO: 1558 - RNA, 19 nt, Artificial Sequence
  Synthetic
cuauuguaaggacuaagua

SEQ ID NO: 1559 - RNA, 19 nt, Artificial Sequence
  Synthetic
ccuauuguaaggacuaagu

SEQ ID NO: 1560 - RNA, 19 nt, Artificial Sequence
  Synthetic
uuguuauaggguaacaaag

SEQ ID NO: 1561 - RNA, 19 nt, Artificial Sequence
  Synthetic
uuuguuauaggguaacaaa

SEQ ID NO: 1562 - RNA, 19 nt, Artificial Sequence
  Synthetic
uuuuguuauaggguaacaa

SEQ ID NO: 1563 - RNA, 19 nt, Artificial Sequence
  Synthetic
uuuuuguuauaggguaaca

SEQ ID NO: 1564 - RNA, 19 nt, Artificial Sequence
  Synthetic
uuuuuuguuauaggguaac

SEQ ID NO: 1565 - RNA, 19 nt, Artificial Sequence
  Synthetic
uuuuuuuguuauaggguaa

SEQ ID NO: 1566 - RNA, 19 nt, Artificial Sequence
  Synthetic
cuuuuuuuguuauagggua

SEQ ID NO: 1567 - RNA, 19 nt, Artificial Sequence
  Synthetic
ccuuuuuuuguuauagggu

SEQ ID NO: 1568 - RNA, 19 nt, Artificial Sequence
  Synthetic
uccuuuuuuuguuauaggg

SEQ ID NO: 1569 - RNA, 19 nt, Artificial Sequence
  Synthetic
uuccuuuuuuuguuauagg

SEQ ID NO: 1570 - RNA, 19 nt, Artificial Sequence
  Synthetic
auuccuuuuuuuguuauag

SEQ ID NO: 1571 - RNA, 19 nt, Artificial Sequence
  Synthetic
aauuccuuuuuuuguuaua

SEQ ID NO: 1572 - RNA, 19 nt, Artificial Sequence
  Synthetic
uaauuccuuuuuuuguuau

SEQ ID NO: 1573 - RNA, 19 nt, Artificial Sequence
  Synthetic
uuaauuccuuuuuuuguua

SEQ ID NO: 1574 - RNA, 19 nt, Artificial Sequence
  Synthetic
aaaagugucaaaaacuaau

SEQ ID NO: 1575 - RNA, 19 nt, Artificial Sequence
  Synthetic
aaaaagugucaaaaacuaa

SEQ ID NO: 1576 - RNA, 19 nt, Artificial Sequence
  Synthetic
aaaaaagugucaaaaacua

SEQ ID NO: 1577 - RNA, 19 nt, Artificial Sequence
  Synthetic
aaaaaaagugucaaaaacu

SEQ ID NO: 1578 - RNA, 19 nt, Artificial Sequence
  Synthetic
gaaaaaaagugucaaaaac

SEQ ID NO: 1579 - RNA, 19 nt, Artificial Sequence
  Synthetic
agaaaaaaagugucaaaaa

SEQ ID NO: 1580 - RNA, 19 nt, Artificial Sequence
  Synthetic
gagaaaaaaagugucaaaa

SEQ ID NO: 1581 - RNA, 19 nt, Artificial Sequence
  Synthetic
uuuucuagauucuaucuca

SEQ ID NO: 1582 - RNA, 19 nt, Artificial Sequence
  Synthetic
auuuucuagauucuaucuc

SEQ ID NO: 1583 - RNA, 19 nt, Artificial Sequence
  Synthetic
gauuuucuagauucuaucu

SEQ ID NO: 1584 - RNA, 19 nt, Artificial Sequence
  Synthetic
ggauuuucuagauucuauc

SEQ ID NO: 1585 - RNA, 19 nt, Artificial Sequence
  Synthetic
aggauuuucuagauucuau

SEQ ID NO: 1586 - RNA, 19 nt, Artificial Sequence
  Synthetic
uaggauuuucuagauucua

SEQ ID NO: 1587 - RNA, 19 nt, Artificial Sequence
  Synthetic
guaggauuuucuagauucu

SEQ ID NO: 1588 - RNA, 19 nt, Artificial Sequence
  Synthetic
uguaggauuuucuagauuc

SEQ ID NO: 1589 - RNA, 19 nt, Artificial Sequence
  Synthetic
uuguaggauuuucuagauu

SEQ ID NO: 1590 - RNA, 19 nt, Artificial Sequence
  Synthetic
uuuguaggauuuucuagau

SEQ ID NO: 1591 - RNA, 19 nt, Artificial Sequence
  Synthetic
uuuuguaggauuuucuaga

SEQ ID NO: 1592 - RNA, 19 nt, Artificial Sequence
  Synthetic
uuuuuguaggauuuucuag

SEQ ID NO: 1593 - RNA, 19 nt, Artificial Sequence
  Synthetic
uuuuuuguaggauuuucua

SEQ ID NO: 1594 - RNA, 19 nt, Artificial Sequence
  Synthetic
uuuuuuuguaggauuuucu

SEQ ID NO: 1595 - RNA, 19 nt, Artificial Sequence
  Synthetic
auuuuuuuguaggauuuuc

SEQ ID NO: 1596 - RNA, 19 nt, Artificial Sequence
  Synthetic
cauuuuuuuguaggauuuu

SEQ ID NO: 1597 - RNA, 19 nt, Artificial Sequence
  Synthetic
gcauuuuuuuguaggauuu

SEQ ID NO: 1598 - RNA, 19 nt, Artificial Sequence
  Synthetic
agcauuuuuuuguaggauu

SEQ ID NO: 1599 - RNA, 19 nt, Artificial Sequence
  Synthetic
uagcauuuuuuuguaggau

SEQ ID NO: 1600 - RNA, 19 nt, Artificial Sequence
  Synthetic
aggcauucauaaacaaucc

SEQ ID NO: 1601 - RNA, 19 nt, Artificial Sequence
  Synthetic
uaggcauucauaaacaauc

SEQ ID NO: 1602 - RNA, 19 nt, Artificial Sequence
  Synthetic
auaggcauucauaaacaau

SEQ ID NO: 1603 - RNA, 19 nt, Artificial Sequence
  Synthetic
cauaggcauucauaaacaa

SEQ ID NO: 1604 - RNA, 19 nt, Artificial Sequence
  Synthetic
ccauaggcauucauaaaca

SEQ ID NO: 1605 - RNA, 19 nt, Artificial Sequence
  Synthetic
accauaggcauucauaaac

SEQ ID NO: 1606 - RNA, 19 nt, Artificial Sequence
  Synthetic
gguuacuucuauaucuauu

SEQ ID NO: 1607 - RNA, 19 nt, Artificial Sequence
  Synthetic
ugguuacuucuauaucuau

SEQ ID NO: 1608 - RNA, 19 nt, Artificial Sequence
  Synthetic
uugguuacuucuauaucua

SEQ ID NO: 1609 - RNA, 19 nt, Artificial Sequence
  Synthetic
uuugguuacuucuauaucu

SEQ ID NO: 1610 - RNA, 19 nt, Artificial Sequence
  Synthetic
cuuugguuacuucuauauc

SEQ ID NO: 1611 - RNA, 19 nt, Artificial Sequence
  Synthetic
ucuuugguuacuucuauau

SEQ ID NO: 1612 - RNA, 19 nt, Artificial Sequence
  Synthetic
uguuaucaaauguuucuau

SEQ ID NO: 1613 - RNA, 19 nt, Artificial Sequence
  Synthetic
uuguuaucaaauguuucua

SEQ ID NO: 1614 - RNA, 19 nt, Artificial Sequence
  Synthetic
auuguuaucaaauguuucu

SEQ ID NO: 1615 - RNA, 19 nt, Artificial Sequence
  Synthetic
cauuguuaucaaauguuuc

SEQ ID NO: 1616 - RNA, 19 nt, Artificial Sequence
  Synthetic
ucauuguuaucaaauguuu

SEQ ID NO: 1617 - RNA, 19 nt, Artificial Sequence
  Synthetic
uucauuguuaucaaauguu

SEQ ID NO: 1618 - RNA, 19 nt, Artificial Sequence
  Synthetic
guugagauuaucauugcca

SEQ ID NO: 1619 - RNA, 19 nt, Artificial Sequence
  Synthetic
uaucuaauucuuguuuuau

SEQ ID NO: 1620 - RNA, 19 nt, Artificial Sequence
  Synthetic
uuaucuaauucuuguuuua

SEQ ID NO: 1621 - RNA, 19 nt, Artificial Sequence
  Synthetic
uuauaggcauaucauugau

SEQ ID NO: 1622 - RNA, 19 nt, Artificial Sequence
  Synthetic
guuauaggcauaucauuga

SEQ ID NO: 1623 - RNA, 19 nt, Artificial Sequence
  Synthetic
uguuauaggcauaucauug

SEQ ID NO: 1624 - RNA, 19 nt, Artificial Sequence
  Synthetic
uuguuauaggcauaucauu

SEQ ID NO: 1625 - RNA, 19 nt, Artificial Sequence
  Synthetic
uuuguuauaggcauaucau

SEQ ID NO: 1626 - RNA, 19 nt, Artificial Sequence
  Synthetic
auuuguuauaggcauauca

SEQ ID NO: 1627 - RNA, 19 nt, Artificial Sequence
  Synthetic
cauuuguuauaggcauauc

SEQ ID NO: 1628 - RNA, 19 nt, Artificial Sequence
  Synthetic
ucauuuguuauaggcauau

SEQ ID NO: 1629 - RNA, 19 nt, Artificial Sequence
  Synthetic
aucauuuguuauaggcaua

SEQ ID NO: 1630 - RNA, 19 nt, Artificial Sequence
  Synthetic
gaucauuuguuauaggcau

SEQ ID NO: 1631 - RNA, 19 nt, Artificial Sequence
  Synthetic
ugaucauuuguuauaggca

SEQ ID NO: 1632 - RNA, 19 nt, Artificial Sequence
  Synthetic
cugaucauuuguuauaggc

SEQ ID NO: 1633 - RNA, 19 nt, Artificial Sequence
  Synthetic
ucugaucauuuguuauagg

SEQ ID NO: 1634 - RNA, 19 nt, Artificial Sequence
  Synthetic
uucugaucauuuguuauag

SEQ ID NO: 1635 - RNA, 19 nt, Artificial Sequence
  Synthetic
uuucugaucauuuguuaua

SEQ ID NO: 1636 - RNA, 19 nt, Artificial Sequence
  Synthetic
acacuaauauauauauugu

SEQ ID NO: 1637 - RNA, 19 nt, Artificial Sequence
  Synthetic
gacacuaauauauauauug

SEQ ID NO: 1638 - RNA, 19 nt, Artificial Sequence
  Synthetic
ugacacuaauauauauauu

SEQ ID NO: 1639 - RNA, 19 nt, Artificial Sequence
  Synthetic
augacacuaauauauauau

SEQ ID NO: 1640 - RNA, 19 nt, Artificial Sequence
  Synthetic
caccuuuuaaauaacuauc

SEQ ID NO: 1641 - RNA, 19 nt, Artificial Sequence
  Synthetic
acaccuuuuaaauaacuau

SEQ ID NO: 1642 - RNA, 19 nt, Artificial Sequence
  Synthetic
aacaccuuuuaaauaacua

SEQ ID NO: 1643 - RNA, 19 nt, Artificial Sequence
  Synthetic
uaacaccuuuuaaauaacu

SEQ ID NO: 1644 - RNA, 19 nt, Artificial Sequence
  Synthetic
auaacaccuuuuaaauaac

SEQ ID NO: 1645 - RNA, 19 nt, Artificial Sequence
  Synthetic
aaucauuuuugagauaagg

SEQ ID NO: 1646 - RNA, 19 nt, Artificial Sequence
  Synthetic
uaaucauuuuugagauaag

SEQ ID NO: 1647 - RNA, 19 nt, Artificial Sequence
  Synthetic
gucuacuaauuaaguuggu

SEQ ID NO: 1648 - RNA, 19 nt, Artificial Sequence
  Synthetic
ugucuacuaauuaaguugg

SEQ ID NO: 1649 - RNA, 19 nt, Artificial Sequence
  Synthetic
uugucuacuaauuaaguug

SEQ ID NO: 1650 - RNA, 19 nt, Artificial Sequence
  Synthetic
gauguugcauugaacacau

SEQ ID NO: 1651 - RNA, 19 nt, Artificial Sequence
  Synthetic
ggauguugcauugaacaca

SEQ ID NO: 1652 - RNA, 19 nt, Artificial Sequence
  Synthetic
aggauguugcauugaacac

SEQ ID NO: 1653 - RNA, 19 nt, Artificial Sequence
  Synthetic
gaggauguugcauugaaca

SEQ ID NO: 1654 - RNA, 19 nt, Artificial Sequence
  Synthetic
ggaggauguugcauugaac

SEQ ID NO: 1655 - RNA, 19 nt, Artificial Sequence
  Synthetic
uggaggauguugcauugaa

SEQ ID NO: 1656 - RNA, 19 nt, Artificial Sequence
  Synthetic
auggaggauguugcauuga

SEQ ID NO: 1657 - RNA, 19 nt, Artificial Sequence
  Synthetic
gauggaggauguugcauug

SEQ ID NO: 1658 - RNA, 19 nt, Artificial Sequence
  Synthetic
ugauggaggauguugcauu

SEQ ID NO: 1659 - RNA, 19 nt, Artificial Sequence
  Synthetic
augauggaggauguugcau

SEQ ID NO: 1660 - RNA, 19 nt, Artificial Sequence
  Synthetic
caugauggaggauguugca

SEQ ID NO: 1661 - RNA, 19 nt, Artificial Sequence
  Synthetic
ccaugauggaggauguugc

SEQ ID NO: 1662 - RNA, 19 nt, Artificial Sequence
  Synthetic
accaugauggaggauguug

SEQ ID NO: 1663 - RNA, 19 nt, Artificial Sequence
  Synthetic
aaccaugauggaggauguu

SEQ ID NO: 1664 - RNA, 19 nt, Artificial Sequence
  Synthetic
uaaccaugauggaggaugu

SEQ ID NO: 1665 - RNA, 19 nt, Artificial Sequence
  Synthetic
cuuugagagauauuagauc

SEQ ID NO: 1666 - RNA, 19 nt, Artificial Sequence
  Synthetic
ccuuugagagauauuagau

SEQ ID NO: 1667 - RNA, 19 nt, Artificial Sequence
  Synthetic
cccuuugagagauauuaga

SEQ ID NO: 1668 - RNA, 19 nt, Artificial Sequence
  Synthetic
ucccuuugagagauauuag

SEQ ID NO: 1669 - RNA, 19 nt, Artificial Sequence
  Synthetic
uucccuuugagagauauua

SEQ ID NO: 1670 - RNA, 19 nt, Artificial Sequence
  Synthetic
uuucccuuugagagauauu

SEQ ID NO: 1671 - RNA, 19 nt, Artificial Sequence
  Synthetic
auuucccuuugagagauau

SEQ ID NO: 1672 - RNA, 19 nt, Artificial Sequence
  Synthetic
aauuucccuuugagagaua

SEQ ID NO: 1673 - RNA, 19 nt, Artificial Sequence
  Synthetic
gaauuucccuuugagagau

SEQ ID NO: 1674 - RNA, 19 nt, Artificial Sequence
  Synthetic
agaauuucccuuugagaga

SEQ ID NO: 1675 - RNA, 19 nt, Artificial Sequence
  Synthetic
gagaauuucccuuugagag

SEQ ID NO: 1676 - RNA, 19 nt, Artificial Sequence
  Synthetic
auggucuacuacugacugu

SEQ ID NO: 1677 - RNA, 19 nt, Artificial Sequence
  Synthetic
cauggucuacuacugacug

SEQ ID NO: 1678 - RNA, 19 nt, Artificial Sequence
  Synthetic
acauggucuacuacugacu

SEQ ID NO: 1679 - RNA, 19 nt, Artificial Sequence
  Synthetic
cacauggucuacuacugac

SEQ ID NO: 1680 - RNA, 19 nt, Artificial Sequence
  Synthetic
ucacauggucuacuacuga

SEQ ID NO: 1681 - RNA, 19 nt, Artificial Sequence
  Synthetic
uucacauggucuacuacug

SEQ ID NO: 1682 - RNA, 19 nt, Artificial Sequence
  Synthetic
auucacauggucuacuacu

SEQ ID NO: 1683 - RNA, 19 nt, Artificial Sequence
  Synthetic
aauucacauggucuacuac

SEQ ID NO: 1684 - RNA, 19 nt, Artificial Sequence
  Synthetic
gaauucacauggucuacua

SEQ ID NO: 1685 - RNA, 19 nt, Artificial Sequence
  Synthetic
ggaauucacauggucuacu

SEQ ID NO: 1686 - RNA, 19 nt, Artificial Sequence
  Synthetic
gggaauucacauggucuac

SEQ ID NO: 1687 - RNA, 19 nt, Artificial Sequence
  Synthetic
agggaauucacauggucua

SEQ ID NO: 1688 - RNA, 19 nt, Artificial Sequence
  Synthetic
cagggaauucacauggucu

SEQ ID NO: 1689 - RNA, 19 nt, Artificial Sequence
  Synthetic
gcagggaauucacaugguc

SEQ ID NO: 1690 - RNA, 19 nt, Artificial Sequence
  Synthetic
ugcagggaauucacauggu

SEQ ID NO: 1691 - RNA, 19 nt, Artificial Sequence
  Synthetic
augcuguuuuuguaucacu

SEQ ID NO: 1692 - RNA, 19 nt, Artificial Sequence
  Synthetic
uaugcuguuuuuguaucac

SEQ ID NO: 1693 - RNA, 19 nt, Artificial Sequence
  Synthetic
auaugcuguuuuuguauca

SEQ ID NO: 1694 - RNA, 19 nt, Artificial Sequence
  Synthetic
cauaugcuguuuuuguauc

SEQ ID NO: 1695 - RNA, 19 nt, Artificial Sequence
  Synthetic
acauaugcuguuuuuguau

SEQ ID NO: 1696 - RNA, 19 nt, Artificial Sequence
  Synthetic
aacauaugcuguuuuugua

SEQ ID NO: 1697 - RNA, 19 nt, Artificial Sequence
  Synthetic
aacuaugaucauugcaauc

SEQ ID NO: 1698 - RNA, 19 nt, Artificial Sequence
  Synthetic
aaacuaugaucauugcaau

SEQ ID NO: 1699 - RNA, 19 nt, Artificial Sequence
  Synthetic
uaaacuaugaucauugcaa

SEQ ID NO: 1700 - RNA, 19 nt, Artificial Sequence
  Synthetic
guaaacuaugaucauugca

SEQ ID NO: 1701 - RNA, 19 nt, Artificial Sequence
  Synthetic
gguaaacuaugaucauugc

SEQ ID NO: 1702 - RNA, 19 nt, Artificial Sequence
  Synthetic
agguaaacuaugaucauug

SEQ ID NO: 1703 - RNA, 19 nt, Artificial Sequence
  Synthetic
uagguaaacuaugaucauu

SEQ ID NO: 1704 - RNA, 19 nt, Artificial Sequence
  Synthetic
auagguaaacuaugaucau

SEQ ID NO: 1705 - RNA, 19 nt, Artificial Sequence
  Synthetic
aauagguaaacuaugauca

SEQ ID NO: 1706 - RNA, 19 nt, Artificial Sequence
  Synthetic
caauagguaaacuaugauc

SEQ ID NO: 1707 - RNA, 19 nt, Artificial Sequence
  Synthetic
ucaauagguaaacuaugau

SEQ ID NO: 1708 - RNA, 19 nt, Artificial Sequence
  Synthetic
uguauuugcuggaugacag

SEQ ID NO: 1709 - RNA, 19 nt, Artificial Sequence
  Synthetic
guguauuugcuggaugaca

SEQ ID NO: 1710 - RNA, 19 nt, Artificial Sequence
  Synthetic
gagauuaucauugccagaa

SEQ ID NO: 1711 - RNA, 19 nt, Artificial Sequence
  Synthetic
ugagauuaucauugccaga

SEQ ID NO: 1712 - RNA, 19 nt, Artificial Sequence
  Synthetic
uugagauuaucauugccag

SEQ ID NO: 1713 - RNA, 19 nt, Artificial Sequence
  Synthetic
aauaaucugcuugagcaug

SEQ ID NO: 1714 - RNA, 19 nt, Artificial Sequence
  Synthetic
aaauaaucugcuugagcau

SEQ ID NO: 1715 - RNA, 19 nt, Artificial Sequence
  Synthetic
caaauaaucugcuugagca

SEQ ID NO: 1716 - RNA, 19 nt, Artificial Sequence
  Synthetic
guuacauaaugcaugauuu

SEQ ID NO: 1717 - RNA, 19 nt, Artificial Sequence
  Synthetic
uguuacauaaugcaugauu

SEQ ID NO: 1718 - RNA, 19 nt, Artificial Sequence
  Synthetic
uuguuacauaaugcaugau

SEQ ID NO: 1719 - RNA, 19 nt, Artificial Sequence
  Synthetic
auuguuacauaaugcauga

SEQ ID NO: 1720 - RNA, 19 nt, Artificial Sequence
  Synthetic
uauuguuacauaaugcaug

SEQ ID NO: 1721 - RNA, 19 nt, Artificial Sequence
  Synthetic
uuauuguuacauaaugcau

SEQ ID NO: 1722 - RNA, 19 nt, Artificial Sequence
  Synthetic
ucaagugauagaucauugu

SEQ ID NO: 1723 - RNA, 19 nt, Artificial Sequence
  Synthetic
augccugcauacucuuuau

SEQ ID NO: 1724 - RNA, 19 nt, Artificial Sequence
  Synthetic
ucuauauuuugcauaauau

SEQ ID NO: 1725 - RNA, 19 nt, Artificial Sequence
  Synthetic
ucaucauugaauuuguguu

SEQ ID NO: 1726 - RNA, 19 nt, Artificial Sequence
  Synthetic
aagugguacuuaucaaauu

SEQ ID NO: 1727 - RNA, 19 nt, Artificial Sequence
  Synthetic
accaagggaguuaaauuua

SEQ ID NO: 1728 - RNA, 19 nt, Artificial Sequence
  Synthetic
aauugcugcccaucucuaa

SEQ ID NO: 1729 - RNA, 19 nt, Artificial Sequence
  Synthetic
acaaauuuuguaaucuaac

SEQ ID NO: 1730 - RNA, 19 nt, Artificial Sequence
  Synthetic
cuacuucaucauugucaaa

SEQ ID NO: 1731 - RNA, 19 nt, Artificial Sequence
  Synthetic
guaucacugccuuagccaa

SEQ ID NO: 1732 - RNA, 19 nt, Artificial Sequence
  Synthetic
cauucaauuugauuguaug

SEQ ID NO: 1733 - RNA, 19 nt, Artificial Sequence
  Synthetic
uaucacuacuuguaauaac

SEQ ID NO: 1734 - RNA, 19 nt, Artificial Sequence
  Synthetic
auuccaucauuucccauau

SEQ ID NO: 1735 - RNA, 19 nt, Artificial Sequence
  Synthetic
auuuaauuucacaauuguc

SEQ ID NO: 1736 - RNA, 19 nt, Artificial Sequence
  Synthetic
cacuuaguuuuuuggagaa

SEQ ID NO: 1737 - RNA, 19 nt, Artificial Sequence
  Synthetic
aauuggucauuguugaauc

SEQ ID NO: 1738 - RNA, 19 nt, Artificial Sequence
  Synthetic
cagauaauugauucauaua

SEQ ID NO: 1739 - RNA, 19 nt, Artificial Sequence
  Synthetic
gaucaaauccaaguaauuc

SEQ ID NO: 1740 - RNA, 19 nt, Artificial Sequence
  Synthetic
uuauaauuuauggauuaag

SEQ ID NO: 1741 - RNA, 19 nt, Artificial Sequence
  Synthetic
aaguuuuauauuaacuaau

SEQ ID NO: 1742 - RNA, 19 nt, Artificial Sequence
  Synthetic
cugucuuucaucaaguuuu

SEQ ID NO: 1743 - RNA, 19 nt, Artificial Sequence
  Synthetic
caggaauguaaauguggcc

SEQ ID NO: 1744 - RNA, 19 nt, Artificial Sequence
  Synthetic
uuucauuucauaguugacc

SEQ ID NO: 1745 - RNA, 19 nt, Artificial Sequence
  Synthetic
uguguuguauucaguauau

SEQ ID NO: 1746 - RNA, 19 nt, Artificial Sequence
  Synthetic
uucuaagaacccaucauga

SEQ ID NO: 1747 - RNA, 19 nt, Artificial Sequence
  Synthetic
aggcuuaaugccaaugcau

SEQ ID NO: 1748 - RNA, 19 nt, Artificial Sequence
  Synthetic
gagaucauacuuguauauu

SEQ ID NO: 1749 - RNA, 19 nt, Artificial Sequence
  Synthetic
guguaucauucaacuugac

SEQ ID NO: 1750 - RNA, 19 nt, Artificial Sequence
  Synthetic
gaaguugaucuuuguugag

SEQ ID NO: 1751 - RNA, 19 nt, Artificial Sequence
  Synthetic
cugugcuccguuggauggu

SEQ ID NO: 1752 - RNA, 19 nt, Artificial Sequence
  Synthetic
gaguaucaauacuaucucc

SEQ ID NO: 1753 - RNA, 19 nt, Artificial Sequence
  Synthetic
ucugcacaucauaauuagg

SEQ ID NO: 1754 - RNA, 19 nt, Artificial Sequence
  Synthetic
auaacuuauugauguguuu

SEQ ID NO: 1755 - RNA, 19 nt, Artificial Sequence
  Synthetic
ugauuaauaacaugccaca

SEQ ID NO: 1756 - RNA, 19 nt, Artificial Sequence
  Synthetic
uaugauuagcaucuucugu

SEQ ID NO: 1757 - RNA, 19 nt, Artificial Sequence
  Synthetic
cuauuaacccagugaauuu

SEQ ID NO: 1758 - RNA, 19 nt, Artificial Sequence
  Synthetic
acauagcauauaacauacc

SEQ ID NO: 1759 - RNA, 19 nt, Artificial Sequence
  Synthetic
ugaguauuuuuaugguguc

SEQ ID NO: 1760 - RNA, 19 nt, Artificial Sequence
  Synthetic
caugauaucccgcaucucu

SEQ ID NO: 1761 - RNA, 19 nt, Artificial Sequence
  Synthetic
gacgauguguuguuacauc

SEQ ID NO: 1762 - RNA, 19 nt, Artificial Sequence
  Synthetic
acacuucaaauuucauuuc

SEQ ID NO: 1763 - RNA, 19 nt, Artificial Sequence
  Synthetic
ugauuugaauuucaguugu

SEQ ID NO: 1764 - RNA, 19 nt, Artificial Sequence
  Synthetic
uagauucuaucucaauguu

SEQ ID NO: 1765 - RNA, 19 nt, Artificial Sequence
  Synthetic
cucccauuucuuuuagcau

SEQ ID NO: 1766 - RNA, 19 nt, Artificial Sequence
  Synthetic
uguauucuggagcuaccuc

SEQ ID NO: 1767 - RNA, 19 nt, Artificial Sequence
  Synthetic
auaauauuaucaucccaca

SEQ ID NO: 1768 - RNA, 19 nt, Artificial Sequence
  Synthetic
uuuuuaggacauuauuagc

SEQ ID NO: 1769 - RNA, 19 nt, Artificial Sequence
  Synthetic
ccuuggguaguaagccuuu

SEQ ID NO: 1770 - RNA, 19 nt, Artificial Sequence
  Synthetic
uaccaaaaugaacaaaaac

SEQ ID NO: 1771 - RNA, 19 nt, Artificial Sequence
  Synthetic
caacucuacugccaccucu

SEQ ID NO: 1772 - RNA, 19 nt, Artificial Sequence
  Synthetic
ccauuucugcuugcacacu

SEQ ID NO: 1773 - RNA, 19 nt, Artificial Sequence
  Synthetic
auuuuugggcauauucaua

SEQ ID NO: 1774 - RNA, 19 nt, Artificial Sequence
  Synthetic
auaaugaugcuuuuggguu

SEQ ID NO: 1775 - RNA, 19 nt, Artificial Sequence
  Synthetic
cagcagcauugccuaauac

SEQ ID NO: 1776 - RNA, 19 nt, Artificial Sequence
  Synthetic
cucccauuaugccuaggcc

SEQ ID NO: 1777 - RNA, 19 nt, Artificial Sequence
  Synthetic
cauauagaucuugauuccu

SEQ ID NO: 1778 - RNA, 19 nt, Artificial Sequence
  Synthetic
uuucuuugaguuguucagc

SEQ ID NO: 1779 - RNA, 19 nt, Artificial Sequence
  Synthetic
uguaguuaaucacaccauu

SEQ ID NO: 1780 - RNA, 19 nt, Artificial Sequence
  Synthetic
uagccucuaguucuucugc

SEQ ID NO: 1781 - RNA, 19 nt, Artificial Sequence
  Synthetic
gauuaagcugauguuugau

SEQ ID NO: 1782 - RNA, 19 nt, Artificial Sequence
  Synthetic
cuacaucauuaucuuuugg

SEQ ID NO: 1783 - RNA, 19 nt, Artificial Sequence
  Synthetic
uuuuauuaacucaaagcuc

SEQ ID NO: 1784 - RNA, 19 nt, Artificial Sequence
  Synthetic
ucuccauggaauucaggag

SEQ ID NO: 1785 - RNA, 19 nt, Artificial Sequence
  Synthetic
gugaauuugcccuuuauug

SEQ ID NO: 1786 - RNA, 19 nt, Artificial Sequence
  Synthetic
augauacuaucuuuuuucu

SEQ ID NO: 1787 - RNA, 19 nt, Artificial Sequence
  Synthetic
ucuauugaguugacagaua

SEQ ID NO: 1788 - RNA, 19 nt, Artificial Sequence
  Synthetic
uuugauguuauagggcuuu

SEQ ID NO: 1789 - RNA, 19 nt, Artificial Sequence
  Synthetic
ucaucugucucauuuguug

SEQ ID NO: 1790 - RNA, 19 nt, Artificial Sequence
  Synthetic
gguuuucuuugauaauugg

SEQ ID NO: 1791 - RNA, 19 nt, Artificial Sequence
  Synthetic
ucuuugaaacuuacuagag

SEQ ID NO: 1792 - RNA, 19 nt, Artificial Sequence
  Synthetic
ucuaugguuucuuuguaua

SEQ ID NO: 1793 - RNA, 19 nt, Artificial Sequence
  Synthetic
cuuaauuuuucaucaaucc

SEQ ID NO: 1794 - RNA, 19 nt, Artificial Sequence
  Synthetic
agcauuccuaguauuucac

SEQ ID NO: 1795 - RNA, 19 nt, Artificial Sequence
  Synthetic
aaaccaaccauggcaucuc

SEQ ID NO: 1796 - RNA, 19 nt, Artificial Sequence
  Synthetic
gcuucaguucugauuuuuu

SEQ ID NO: 1797 - RNA, 19 nt, Artificial Sequence
  Synthetic
cugucauuggucauuaaug

SEQ ID NO: 1798 - RNA, 19 nt, Artificial Sequence
  Synthetic
cuuuccucauuccugaguc

SEQ ID NO: 1799 - RNA, 19 nt, Artificial Sequence
  Synthetic
ucuuuugccaucuuuucac

SEQ ID NO: 1800 - RNA, 19 nt, Artificial Sequence
  Synthetic
gacacuucaucugaugugu

SEQ ID NO: 1801 - RNA, 19 nt, Artificial Sequence
  Synthetic
ucugauguuggauugagag

SEQ ID NO: 1802 - RNA, 19 nt, Artificial Sequence
  Synthetic
ucacuaucauucccuucca

SEQ ID NO: 1803 - RNA, 19 nt, Artificial Sequence
  Synthetic
acauuguauugaacagcag

SEQ ID NO: 1804 - RNA, 19 nt, Artificial Sequence
  Synthetic
auuguaagugaugcagggu

SEQ ID NO: 1805 - RNA, 19 nt, Artificial Sequence
  Synthetic
uggaacaugggcacccaua

SEQ ID NO: 1806 - RNA, 19 nt, Artificial Sequence
  Synthetic
aguucuuuuauaaguaaau

SEQ ID NO: 1807 - RNA, 19 nt, Artificial Sequence
  Synthetic
aguauguugacauuagcua

SEQ ID NO: 1808 - RNA, 19 nt, Artificial Sequence
  Synthetic
guggauauuuguuucacua

SEQ ID NO: 1809 - RNA, 19 nt, Artificial Sequence
  Synthetic
gaguuuaucaugacucuua

SEQ ID NO: 1810 - RNA, 19 nt, Artificial Sequence
  Synthetic
aauuugcugggcauuugug

SEQ ID NO: 1811 - RNA, 19 nt, Artificial Sequence
  Synthetic
cuucuuucauccaaggaca

SEQ ID NO: 1812 - RNA, 19 nt, Artificial Sequence
  Synthetic
auuucacagggugugguua

SEQ ID NO: 1813 - RNA, 19 nt, Artificial Sequence
  Synthetic
guuagacuacaugccuuga

SEQ ID NO: 1814 - RNA, 19 nt, Artificial Sequence
  Synthetic
uuuuuugauuuuaggcaug

SEQ ID NO: 1815 - RNA, 19 nt, Artificial Sequence
  Synthetic
auuaugacuuuuuuugaug

SEQ ID NO: 1816 - RNA, 19 nt, Artificial Sequence
  Synthetic
gaucuuagguauguuggua

SEQ ID NO: 1817 - RNA, 19 nt, Artificial Sequence
  Synthetic
uuauuucugacacugaugg

SEQ ID NO: 1818 - RNA, 19 nt, Artificial Sequence
  Synthetic
ucaaguguguucagaucuu

SEQ ID NO: 1819 - RNA, 19 nt, Artificial Sequence
  Synthetic
ucagugguuguuauauuuu

SEQ ID NO: 1820 - RNA, 19 nt, Artificial Sequence
  Synthetic
gggaugauuuuugcauuug

SEQ ID NO: 1821 - RNA, 19 nt, Artificial Sequence
  Synthetic
ucagucacugugaugacua

SEQ ID NO: 1822 - RNA, 19 nt, Artificial Sequence
  Synthetic
uugaaugcuccuuuguugu

SEQ ID NO: 1823 - RNA, 19 nt, Artificial Sequence
  Synthetic
uuuucuagguaagcuccaa

SEQ ID NO: 1824 - RNA, 19 nt, Artificial Sequence
  Synthetic
acauaauauauacuuucuu

SEQ ID NO: 1825 - RNA, 19 nt, Artificial Sequence
  Synthetic
gcaaaucguguagcugugu

SEQ ID NO: 1826 - RNA, 19 nt, Artificial Sequence
  Synthetic
ucuuccauggguuugauug

SEQ ID NO: 1827 - RNA, 19 nt, Artificial Sequence
  Synthetic
uguagguagaaaguuugua

SEQ ID NO: 1828 - RNA, 19 nt, Artificial Sequence
  Synthetic
aaugacuugggaugaucug

SEQ ID NO: 1829 - RNA, 19 nt, Artificial Sequence
  Synthetic
agauauugugauuaguugg

SEQ ID NO: 1830 - RNA, 19 nt, Artificial Sequence
  Synthetic
gauguauuuuccauugguu

SEQ ID NO: 1831 - RNA, 19 nt, Artificial Sequence
  Synthetic
gagaauucuauuguuaugg

SEQ ID NO: 1832 - RNA, 19 nt, Artificial Sequence
  Synthetic
uaaggccagaauuugcuug

SEQ ID NO: 1833 - RNA, 19 nt, Artificial Sequence
  Synthetic
auguguauuaguguaaagu

SEQ ID NO: 1834 - RNA, 19 nt, Artificial Sequence
  Synthetic
gagauuaugauuagcaaag

SEQ ID NO: 1835 - RNA, 19 nt, Artificial Sequence
  Synthetic
uuguuauggaauacguuau

SEQ ID NO: 1836 - RNA, 19 nt, Artificial Sequence
  Synthetic
uggacauguuugcauuugc

SEQ ID NO: 1837 - RNA, 19 nt, Artificial Sequence
  Synthetic
ugcguugguccuuguuuuu

SEQ ID NO: 1838 - RNA, 19 nt, Artificial Sequence
  Synthetic
uggauaaugugauuugugc

SEQ ID NO: 1839 - RNA, 19 nt, Artificial Sequence
  Synthetic
agauuaucauugccagaau

SEQ ID NO: 1840 - RNA, 19 nt, Artificial Sequence
  Synthetic
cuuugugguuugccgaggc

SEQ ID NO: 1841 - RNA, 19 nt, Artificial Sequence
  Synthetic
uuguugcaucuuguaugau

SEQ ID NO: 1842 - RNA, 19 nt, Artificial Sequence
  Synthetic
uuguguucuugaucuggcu

SEQ ID NO: 1843 - RNA, 19 nt, Artificial Sequence
  Synthetic
agugaaaaucauuauuggg

SEQ ID NO: 1844 - RNA, 19 nt, Artificial Sequence
  Synthetic
agcagguuggauuguugcu

SEQ ID NO: 1845 - RNA, 19 nt, Artificial Sequence
  Synthetic
uguuuguuuuggugguguu

SEQ ID NO: 1846 - RNA, 19 nt, Artificial Sequence
  Synthetic
cuccauuguuauuugcccc

SEQ ID NO: 1847 - RNA, 19 nt, Artificial Sequence
  Synthetic
aaauucuucagugauguuu

SEQ ID NO: 1848 - RNA, 19 nt, Artificial Sequence
  Synthetic
acuuaauucuauaguuaua

SEQ ID NO: 1849 - RNA, 19 nt, Artificial Sequence
  Synthetic
uugcaugagcaacugcaau

SEQ ID NO: 1850 - RNA, 19 nt, Artificial Sequence
  Synthetic
uucucuucuggcucgauug

SEQ ID NO: 1851 - RNA, 19 nt, Artificial Sequence
  Synthetic
auucauaaaccuugguagu

SEQ ID NO: 1852 - RNA, 19 nt, Artificial Sequence
  Synthetic
uuuccuuuucuugcuuaau

SEQ ID NO: 1853 - RNA, 19 nt, Artificial Sequence
  Synthetic
agauccaacaccuaacaaa

SEQ ID NO: 1854 - RNA, 19 nt, Artificial Sequence
  Synthetic
caggaccuuagauacagca

SEQ ID NO: 1855 - RNA, 19 nt, Artificial Sequence
  Synthetic
cuuguuuguggauaguaga

SEQ ID NO: 1856 - RNA, 19 nt, Artificial Sequence
  Synthetic
gucuaacacuuugcugguu

SEQ ID NO: 1857 - RNA, 19 nt, Artificial Sequence
  Synthetic
aucuauauaguuuuugagg

SEQ ID NO: 1858 - RNA, 19 nt, Artificial Sequence
  Synthetic
uagucuguuguucuuuugu

SEQ ID NO: 1859 - RNA, 19 nt, Artificial Sequence
  Synthetic
uucccugguaaucucuagu

SEQ ID NO: 1860 - RNA, 19 nt, Artificial Sequence
  Synthetic
uauaggcauaucauugauu

SEQ ID NO: 1861 - RNA, 19 nt, Artificial Sequence
  Synthetic
cuuuuucugaucauuuguu

SEQ ID NO: 1862 - RNA, 19 nt, Artificial Sequence
  Synthetic
aacauuguuggacauuaac

SEQ ID NO: 1863 - RNA, 19 nt, Artificial Sequence
  Synthetic
uugcugucuaacuauuuga

SEQ ID NO: 1864 - RNA, 19 nt, Artificial Sequence
  Synthetic
ggacaugauagaguaacuu

SEQ ID NO: 1865 - RNA, 19 nt, Artificial Sequence
  Synthetic
uuguacuacauaugcuaag

SEQ ID NO: 1866 - RNA, 19 nt, Artificial Sequence
  Synthetic
uguguugguuguacauaga

SEQ ID NO: 1867 - RNA, 19 nt, Artificial Sequence
  Synthetic
gucacaguaccauccucug

SEQ ID NO: 1868 - RNA, 19 nt, Artificial Sequence
  Synthetic
agauacugauccugcauug

SEQ ID NO: 1869 - RNA, 19 nt, Artificial Sequence
  Synthetic
uguuaaacuguucauugug

SEQ ID NO: 1870 - RNA, 19 nt, Artificial Sequence
  Synthetic
auuuacuucacuugguaau

SEQ ID NO: 1871 - RNA, 19 nt, Artificial Sequence
  Synthetic
gcugcuuacaucuguuuuu

SEQ ID NO: 1872 - RNA, 19 nt, Artificial Sequence
  Synthetic
uagagaugugauaacggag

SEQ ID NO: 1873 - RNA, 19 nt, Artificial Sequence
  Synthetic
gcaugacacaauggcuccu

SEQ ID NO: 1874 - RNA, 19 nt, Artificial Sequence
  Synthetic
acauuuaguuuugccauag

SEQ ID NO: 1875 - RNA, 19 nt, Artificial Sequence
  Synthetic
auuuuuauuggaugcugua

SEQ ID NO: 1876 - RNA, 19 nt, Artificial Sequence
  Synthetic
ugucuuuaugauuccacga

SEQ ID NO: 1877 - RNA, 19 nt, Artificial Sequence
  Synthetic
auuuauuauugguucaccu

SEQ ID NO: 1878 - RNA, 19 nt, Artificial Sequence
  Synthetic
uaauucaucggauuuacga

SEQ ID NO: 1879 - RNA, 19 nt, Artificial Sequence
  Synthetic
uauaguaguuaucaugaua

SEQ ID NO: 1880 - RNA, 19 nt, Artificial Sequence
  Synthetic
uacuauaaucacuauaauu

SEQ ID NO: 1881 - RNA, 19 nt, Artificial Sequence
  Synthetic
aauuaaugauaacaauauu

SEQ ID NO: 1882 - RNA, 19 nt, Artificial Sequence
  Synthetic
gcuuagugugacuggugug

SEQ ID NO: 1883 - RNA, 19 nt, Artificial Sequence
  Synthetic
aaaugcaauauuauuuaua

SEQ ID NO: 1884 - RNA, 19 nt, Artificial Sequence
  Synthetic
aagaacaugauuaggugcu

SEQ ID NO: 1885 - RNA, 19 nt, Artificial Sequence
  Synthetic
agauggguugucuaugagc

SEQ ID NO: 1886 - RNA, 19 nt, Artificial Sequence
  Synthetic
uucgaugaaguucagauuu

SEQ ID NO: 1887 - RNA, 19 nt, Artificial Sequence
  Synthetic
auaaacuaggaaucuacuu

SEQ ID NO: 1888 - RNA, 19 nt, Artificial Sequence
  Synthetic
uuugcaaggauuccuucgu

SEQ ID NO: 1889 - RNA, 19 nt, Artificial Sequence
  Synthetic
augaccucgaauuucaaau

SEQ ID NO: 1890 - RNA, 19 nt, Artificial Sequence
  Synthetic
ggguggccauucaaaauaa

SEQ ID NO: 1891 - RNA, 19 nt, Artificial Sequence
  Synthetic
guuuaacauaaaguuuugu

SEQ ID NO: 1892 - RNA, 19 nt, Artificial Sequence
  Synthetic
cauagacuuaaguauucug

SEQ ID NO: 1893 - RNA, 19 nt, Artificial Sequence
  Synthetic
ucuguccaacucugcagcu

SEQ ID NO: 1894 - RNA, 19 nt, Artificial Sequence
  Synthetic
ggcaacacaugcugauugu

SEQ ID NO: 1895 - RNA, 19 nt, Artificial Sequence
  Synthetic
agugaggaguuugcucaug

SEQ ID NO: 1896 - RNA, 19 nt, Artificial Sequence
  Synthetic
guacacucuuaucuugggu

SEQ ID NO: 1897 - RNA, 19 nt, Artificial Sequence
  Synthetic
auaugauaugacaguauug

SEQ ID NO: 1898 - RNA, 19 nt, Artificial Sequence
  Synthetic
uuuccuguugcuuucaaua

SEQ ID NO: 1899 - RNA, 19 nt, Artificial Sequence
  Synthetic
gauaguuuguuuauuguuu

SEQ ID NO: 1900 - RNA, 19 nt, Artificial Sequence
  Synthetic
caaucuuuuuaacagaugg

SEQ ID NO: 1901 - RNA, 19 nt, Artificial Sequence
  Synthetic
cuucaauacgucugcuggc

SEQ ID NO: 1902 - RNA, 19 nt, Artificial Sequence
  Synthetic
gguaguaucauuauuuuug

SEQ ID NO: 1903 - RNA, 19 nt, Artificial Sequence
  Synthetic
cuacaaggauauuugucag

SEQ ID NO: 1904 - RNA, 19 nt, Artificial Sequence
  Synthetic
uugaaauauaguguguucu

SEQ ID NO: 1905 - RNA, 19 nt, Artificial Sequence
  Synthetic
auugaguguuaugacacua

SEQ ID NO: 1906 - RNA, 19 nt, Artificial Sequence
  Synthetic
uuagcagaauuuccauuaa

SEQ ID NO: 1907 - RNA, 19 nt, Artificial Sequence
  Synthetic
auguaacuuccuaaagcau

SEQ ID NO: 1908 - RNA, 19 nt, Artificial Sequence
  Synthetic
agauaaggaccauugaaua

SEQ ID NO: 1909 - RNA, 19 nt, Artificial Sequence
  Synthetic
uugguauaaucauuuuuga

SEQ ID NO: 1910 - RNA, 19 nt, Artificial Sequence
  Synthetic
uuuugucuacuaauuaagu

SEQ ID NO: 1911 - RNA, 19 nt, Artificial Sequence
  Synthetic
auguguucuauuaauggau

SEQ ID NO: 1912 - RNA, 19 nt, Artificial Sequence
  Synthetic
auuaaggacuguguuauau

SEQ ID NO: 1913 - RNA, 19 nt, Artificial Sequence
  Synthetic
uuguaugucauaaguaaug

SEQ ID NO: 1914 - RNA, 19 nt, Artificial Sequence
  Synthetic
auuaucuuuuuaaguaaau

SEQ ID NO: 1915 - RNA, 19 nt, Artificial Sequence
  Synthetic
auuucuauagcucuucuua

SEQ ID NO: 1916 - RNA, 19 nt, Artificial Sequence
  Synthetic
aguuuauucaauauagcau

SEQ ID NO: 1917 - RNA, 19 nt, Artificial Sequence
  Synthetic
uuguuggauuuaaucuugu

SEQ ID NO: 1918 - RNA, 19 nt, Artificial Sequence
  Synthetic
aguauaucaucuuugauua

SEQ ID NO: 1919 - RNA, 19 nt, Artificial Sequence
  Synthetic
gcuuuaagaugagauugau

SEQ ID NO: 1920 - RNA, 19 nt, Artificial Sequence
  Synthetic
uuaaaccaauguauuaacc

SEQ ID NO: 1921 - RNA, 19 nt, Artificial Sequence
  Synthetic
uacuguguuaauauguugu

SEQ ID NO: 1922 - RNA, 19 nt, Artificial Sequence
  Synthetic
uccuuaugauaaacuauac

SEQ ID NO: 1923 - RNA, 19 nt, Artificial Sequence
  Synthetic
acaguaauucuuuugaguu

SEQ ID NO: 1924 - RNA, 19 nt, Artificial Sequence
  Synthetic
aauugauuauagguuguca

SEQ ID NO: 1925 - RNA, 19 nt, Artificial Sequence
  Synthetic
uuuaaucuacuaaggcuaa

SEQ ID NO: 1926 - RNA, 19 nt, Artificial Sequence
  Synthetic
cauguaauuaaacaaacau

SEQ ID NO: 1927 - RNA, 19 nt, Artificial Sequence
  Synthetic
aagcuuuuauuuaaugugu

SEQ ID NO: 1928 - RNA, 19 nt, Artificial Sequence
  Synthetic
gucaagauaacauuauuga

SEQ ID NO: 1929 - RNA, 19 nt, Artificial Sequence
  Synthetic
accucuuuuauuauguaga

SEQ ID NO: 1930 - RNA, 19 nt, Artificial Sequence
  Synthetic
guuauauuuaaaauuagag

SEQ ID NO: 1931 - RNA, 19 nt, Artificial Sequence
  Synthetic
cugaauugaucuucuucug

SEQ ID NO: 1932 - RNA, 19 nt, Artificial Sequence
  Synthetic
gugauguuguugagcauac

SEQ ID NO: 1933 - RNA, 19 nt, Artificial Sequence
  Synthetic
gcuuuauuagcagcaucug

SEQ ID NO: 1934 - RNA, 19 nt, Artificial Sequence
  Synthetic
aauguaugacauacucuug

SEQ ID NO: 1935 - RNA, 19 nt, Artificial Sequence
  Synthetic
ccauuuauuauauuaucgg

SEQ ID NO: 1936 - RNA, 19 nt, Artificial Sequence
  Synthetic
aauagaauuauccaucugc

SEQ ID NO: 1937 - RNA, 19 nt, Artificial Sequence
  Synthetic
aauuuaaggaacuuacuua

SEQ ID NO: 1938 - RNA, 19 nt, Artificial Sequence
  Synthetic
ucaccugcaagcuuaauua

SEQ ID NO: 1939 - RNA, 19 nt, Artificial Sequence
  Synthetic
agauuguuaagguuauugu

SEQ ID NO: 1940 - RNA, 19 nt, Artificial Sequence
  Synthetic
uguccaaauauucugaaca

SEQ ID NO: 1941 - RNA, 19 nt, Artificial Sequence
  Synthetic
cuuucaucuaccauugggu

SEQ ID NO: 1942 - RNA, 19 nt, Artificial Sequence
  Synthetic
acagcauccauggcuuguc

SEQ ID NO: 1943 - RNA, 19 nt, Artificial Sequence
  Synthetic
aacaaguaaaauuuggucu

SEQ ID NO: 1944 - RNA, 19 nt, Artificial Sequence
  Synthetic
uauauaaaggcaccucuua

SEQ ID NO: 1945 - RNA, 19 nt, Artificial Sequence
  Synthetic
cuguuguaauuauuuacaa

SEQ ID NO: 1946 - RNA, 19 nt, Artificial Sequence
  Synthetic
aaggguaaaacaauagcau

SEQ ID NO: 1947 - RNA, 19 nt, Artificial Sequence
  Synthetic
uaguaaguuaaccaucuua

SEQ ID NO: 1948 - RNA, 19 nt, Artificial Sequence
  Synthetic
ggauaaguguuuaguuuau

SEQ ID NO: 1949 - RNA, 19 nt, Artificial Sequence
  Synthetic
acaaucaaaucucuuucug

SEQ ID NO: 1950 - RNA, 19 nt, Artificial Sequence
  Synthetic
aaccgaaacucacgauaga

SEQ ID NO: 1951 - RNA, 19 nt, Artificial Sequence
  Synthetic
guccauaucaaauuuuuag

SEQ ID NO: 1952 - RNA, 19 nt, Artificial Sequence
  Synthetic
uaauuucuagggaaacuag

SEQ ID NO: 1953 - RNA, 19 nt, Artificial Sequence
  Synthetic
ucggaaaauuuuaauuuuu

SEQ ID NO: 1954 - RNA, 19 nt, Artificial Sequence
  Synthetic
cuucuugauuuaucacucu

SEQ ID NO: 1955 - RNA, 19 nt, Artificial Sequence
  Synthetic
uugaauuuguuaucucuua

SEQ ID NO: 1956 - RNA, 19 nt, Artificial Sequence
  Synthetic
uuguauaaaucacauucau

SEQ ID NO: 1957 - RNA, 19 nt, Artificial Sequence
  Synthetic
cuuugauuaacuacacagu

SEQ ID NO: 1958 - RNA, 19 nt, Artificial Sequence
  Synthetic
aguucucuuucuuugccug

SEQ ID NO: 1959 - RNA, 19 nt, Artificial Sequence
  Synthetic
uguaaaauguuuucagcua

SEQ ID NO: 1960 - RNA, 19 nt, Artificial Sequence
  Synthetic
agacuuucaggaaagaauu

SEQ ID NO: 1961 - RNA, 19 nt, Artificial Sequence
  Synthetic
agaucaccauaucuuguaa

SEQ ID NO: 1962 - RNA, 19 nt, Artificial Sequence
  Synthetic
cgauuugauuuguuacuua

SEQ ID NO: 1963 - RNA, 19 nt, Artificial Sequence
  Synthetic
cacuuacuaauguaauugu

SEQ ID NO: 1964 - RNA, 19 nt, Artificial Sequence
  Synthetic
agaucugugaugauagagc

SEQ ID NO: 1965 - RNA, 19 nt, Artificial Sequence
  Synthetic
gcuugauugaauuugcuga

SEQ ID NO: 1966 - RNA, 19 nt, Artificial Sequence
  Synthetic
acaucacuacaaauacaug

SEQ ID NO: 1967 - RNA, 19 nt, Artificial Sequence
  Synthetic
auuauugugacaugaggaa

SEQ ID NO: 1968 - RNA, 19 nt, Artificial Sequence
  Synthetic
gcaugccuauaugugcaua

SEQ ID NO: 1969 - RNA, 19 nt, Artificial Sequence
  Synthetic
uuaagaucuacaauaugau

SEQ ID NO: 1970 - RNA, 19 nt, Artificial Sequence
  Synthetic
cuuuguucaucuacauugu

SEQ ID NO: 1971 - RNA, 19 nt, Artificial Sequence
  Synthetic
ugauaucuauauaauccac

SEQ ID NO: 1972 - RNA, 19 nt, Artificial Sequence
  Synthetic
cauaguuuuugacaccacc

SEQ ID NO: 1973 - RNA, 19 nt, Artificial Sequence
  Synthetic
gauauagcuucuauggucc

SEQ ID NO: 1974 - RNA, 19 nt, Artificial Sequence
  Synthetic
gauauuagauccaauagug

SEQ ID NO: 1975 - RNA, 19 nt, Artificial Sequence
  Synthetic
uuaauuaaagcaguaauug

SEQ ID NO: 1976 - RNA, 19 nt, Artificial Sequence
  Synthetic
auugauugauugucaccau

SEQ ID NO: 1977 - RNA, 19 nt, Artificial Sequence
  Synthetic
ugaccuuccaugagucuga

SEQ ID NO: 1978 - RNA, 19 nt, Artificial Sequence
  Synthetic
uuuaaugcuagcaaauaau

SEQ ID NO: 1979 - RNA, 19 nt, Artificial Sequence
  Synthetic
gauauauaagucucaguuc

SEQ ID NO: 1980 - RNA, 19 nt, Artificial Sequence
  Synthetic
uguugaauuguuuuacuca

SEQ ID NO: 1981 - RNA, 19 nt, Artificial Sequence
  Synthetic
ggguaauauacaccguuau

SEQ ID NO: 1982 - RNA, 19 nt, Artificial Sequence
  Synthetic
cacggucccacucuuagga

SEQ ID NO: 1983 - RNA, 19 nt, Artificial Sequence
  Synthetic
ucaaguauaguguuuaucc

SEQ ID NO: 1984 - RNA, 19 nt, Artificial Sequence
  Synthetic
agacucacuuugaaaucau

SEQ ID NO: 1985 - RNA, 19 nt, Artificial Sequence
  Synthetic
aaacuaccuauagauucua

SEQ ID NO: 1986 - RNA, 19 nt, Artificial Sequence
  Synthetic
uauucuaauucuuguguca

SEQ ID NO: 1987 - RNA, 19 nt, Artificial Sequence
  Synthetic
uuauauaaccauacauuuc

SEQ ID NO: 1988 - RNA, 19 nt, Artificial Sequence
  Synthetic
agaaccuuuaauaugucca

SEQ ID NO: 1989 - RNA, 19 nt, Artificial Sequence
  Synthetic
aagguuuuuaaguguuuca

SEQ ID NO: 1990 - RNA, 19 nt, Artificial Sequence
  Synthetic
auauuaucaagauuaaaaa

SEQ ID NO: 1991 - RNA, 19 nt, Artificial Sequence
  Synthetic
aauguuaaugcuguaucaa

SEQ ID NO: 1992 - RNA, 19 nt, Artificial Sequence
  Synthetic
ucaccaccaccaaauaaca

SEQ ID NO: 1993 - RNA, 19 nt, Artificial Sequence
  Synthetic
cgauauaacaaguugggau

SEQ ID NO: 1994 - RNA, 19 nt, Artificial Sequence
  Synthetic
guucuucuauagaaacuuc

SEQ ID NO: 1995 - RNA, 19 nt, Artificial Sequence
  Synthetic
acagagugaacuauagccu

SEQ ID NO: 1996 - RNA, 19 nt, Artificial Sequence
  Synthetic
uaauaacuaaguaugaaca

SEQ ID NO: 1997 - RNA, 19 nt, Artificial Sequence
  Synthetic
uucaaucuaucaucugaca

SEQ ID NO: 1998 - RNA, 19 nt, Artificial Sequence
  Synthetic
augcauguuaagaacuuau

SEQ ID NO: 1999 - RNA, 19 nt, Artificial Sequence
  Synthetic
acgaauucagcauuagggu

SEQ ID NO: 2000 - RNA, 19 nt, Artificial Sequence
  Synthetic
ggaucucucaucaauguua

SEQ ID NO: 2001 - RNA, 19 nt, Artificial Sequence
  Synthetic
ucagacccuaaagcuugag

SEQ ID NO: 2002 - RNA, 19 nt, Artificial Sequence
  Synthetic
guaauuuuagcuugucucu

SEQ ID NO: 2003 - RNA, 19 nt, Artificial Sequence
  Synthetic
gcacuuuuggagaauauuu

SEQ ID NO: 2004 - RNA, 19 nt, Artificial Sequence
  Synthetic
ucauuuagaucuaucucug

SEQ ID NO: 2005 - RNA, 19 nt, Artificial Sequence
  Synthetic
ucauaaacaacucuuagcc

SEQ ID NO: 2006 - RNA, 19 nt, Artificial Sequence
  Synthetic
uuauaaaaggguaaacuuu

SEQ ID NO: 2007 - RNA, 19 nt, Artificial Sequence
  Synthetic
uuuacuauuuucucugcuu

SEQ ID NO: 2008 - RNA, 19 nt, Artificial Sequence
  Synthetic
aguauguuaguuauagauu

SEQ ID NO: 2009 - RNA, 19 nt, Artificial Sequence
  Synthetic
ucaauaucuguuaagucua

SEQ ID NO: 2010 - RNA, 19 nt, Artificial Sequence
  Synthetic
aucaucucaguggcucuau

SEQ ID NO: 2011 - RNA, 19 nt, Artificial Sequence
  Synthetic
aaaguuauguuuuuccuca

SEQ ID NO: 2012 - RNA, 19 nt, Artificial Sequence
  Synthetic
auacuuagguuuuccauac

SEQ ID NO: 2013 - RNA, 19 nt, Artificial Sequence
  Synthetic
uauuugcuuaauucaguaa

SEQ ID NO: 2014 - RNA, 19 nt, Artificial Sequence
  Synthetic
caagaucuuucccuaacau

SEQ ID NO: 2015 - RNA, 19 nt, Artificial Sequence
  Synthetic
acuauauuggauaaagacc

SEQ ID NO: 2016 - RNA, 19 nt, Artificial Sequence
  Synthetic
uccauuguauacaugauac

SEQ ID NO: 2017 - RNA, 19 nt, Artificial Sequence
  Synthetic
cguguuaaacuguuaacau

SEQ ID NO: 2018 - RNA, 19 nt, Artificial Sequence
  Synthetic
gaaccaacccaugguuuag

SEQ ID NO: 2019 - RNA, 19 nt, Artificial Sequence
  Synthetic
uuuuucucuuguguagaug

SEQ ID NO: 2020 - RNA, 19 nt, Artificial Sequence
  Synthetic
uuauaaacuggcauuguuu

SEQ ID NO: 2021 - RNA, 19 nt, Artificial Sequence
  Synthetic
uugguuaaaacuugucuau

SEQ ID NO: 2022 - RNA, 19 nt, Artificial Sequence
  Synthetic
aauuuugcuaauagaucua

SEQ ID NO: 2023 - RNA, 19 nt, Artificial Sequence
  Synthetic
gaugcauacacccaaucca

SEQ ID NO: 2024 - RNA, 19 nt, Artificial Sequence
  Synthetic
ucauccuuguuaucuauag

SEQ ID NO: 2025 - RNA, 19 nt, Artificial Sequence
  Synthetic
cugacuguaaggcgaugca

SEQ ID NO: 2026 - RNA, 19 nt, Artificial Sequence
  Synthetic
guuaauaugcgauuaauag

SEQ ID NO: 2027 - RNA, 19 nt, Artificial Sequence
  Synthetic
ucaucaccauacuuuucug

SEQ ID NO: 2028 - RNA, 19 nt, Artificial Sequence
  Synthetic
aagcuuauacaguuuugga

SEQ ID NO: 2029 - RNA, 19 nt, Artificial Sequence
  Synthetic
guaaauuguucuacuacug

SEQ ID NO: 2030 - RNA, 19 nt, Artificial Sequence
  Synthetic
cuguuaggacauacauuag

SEQ ID NO: 2031 - RNA, 19 nt, Artificial Sequence
  Synthetic
aaauguaucucauuaagcu

SEQ ID NO: 2032 - RNA, 19 nt, Artificial Sequence
  Synthetic
auaucaacaucaccuguga

SEQ ID NO: 2033 - RNA, 19 nt, Artificial Sequence
  Synthetic
acuuguuuuaacuugugaa

SEQ ID NO: 2034 - RNA, 19 nt, Artificial Sequence
  Synthetic
auuuugucugguaaaaaca

SEQ ID NO: 2035 - RNA, 19 nt, Artificial Sequence
  Synthetic
acauauugagucaaacuua

SEQ ID NO: 2036 - RNA, 19 nt, Artificial Sequence
  Synthetic
uuacuuaagaauaauucca

SEQ ID NO: 2037 - RNA, 19 nt, Artificial Sequence
  Synthetic
uuagaauuaacaugagauc

SEQ ID NO: 2038 - RNA, 19 nt, Artificial Sequence
  Synthetic
cuuaaaauguaaguauuau

SEQ ID NO: 2039 - RNA, 19 nt, Artificial Sequence
  Synthetic
uuagaaucuuucauaaguu

SEQ ID NO: 2040 - RNA, 19 nt, Artificial Sequence
  Synthetic
auauaucccucuccccaau

SEQ ID NO: 2041 - RNA, 19 nt, Artificial Sequence
  Synthetic
aagaaaacuuucaaauuaa

SEQ ID NO: 2042 - RNA, 19 nt, Artificial Sequence
  Synthetic
uaggucuuauaagcauuga

SEQ ID NO: 2043 - RNA, 19 nt, Artificial Sequence
  Synthetic
uuaugaaaacacaagagau

SEQ ID NO: 2044 - RNA, 19 nt, Artificial Sequence
  Synthetic
ucuauuaauuccaauacac

SEQ ID NO: 2045 - RNA, 19 nt, Artificial Sequence
  Synthetic
gacuuccaauaacuacugu

SEQ ID NO: 2046 - RNA, 19 nt, Artificial Sequence
  Synthetic
aaaaauaccuuagacauag

SEQ ID NO: 2047 - RNA, 19 nt, Artificial Sequence
  Synthetic
uugauaacuuuuuguucua

SEQ ID NO: 2048 - RNA, 19 nt, Artificial Sequence
  Synthetic
acucuauguaaacuugcau

SEQ ID NO: 2049 - RNA, 19 nt, Artificial Sequence
  Synthetic
aagcuaugacauccuuuua

SEQ ID NO: 2050 - RNA, 19 nt, Artificial Sequence
  Synthetic
uucauauguguuggaugau

SEQ ID NO: 2051 - RNA, 19 nt, Artificial Sequence
  Synthetic
auauaaguuaauauugcuu

SEQ ID NO: 2052 - RNA, 19 nt, Artificial Sequence
  Synthetic
cccauucuaacaagaucua

SEQ ID NO: 2053 - RNA, 19 nt, Artificial Sequence
  Synthetic
agauuagaaguauaaaauu

SEQ ID NO: 2054 - RNA, 19 nt, Artificial Sequence
  Synthetic
ugaguauuaucugagaagu

SEQ ID NO: 2055 - RNA, 19 nt, Artificial Sequence
  Synthetic
uuguaauuauuuucuaauu

SEQ ID NO: 2056 - RNA, 19 nt, Artificial Sequence
  Synthetic
guaggaugauauaauuugu

SEQ ID NO: 2057 - RNA, 19 nt, Artificial Sequence
  Synthetic
ucaacauuuuuaccuauac

SEQ ID NO: 2058 - RNA, 19 nt, Artificial Sequence
  Synthetic
aaugguaacauuauugagu

SEQ ID NO: 2059 - RNA, 19 nt, Artificial Sequence
  Synthetic
agcuucuuauuagauaaca

SEQ ID NO: 2060 - RNA, 19 nt, Artificial Sequence
  Synthetic
cuguaauugguucuaauca

SEQ ID NO: 2061 - RNA, 19 nt, Artificial Sequence
  Synthetic
aaauugaaucuauuaauau

SEQ ID NO: 2062 - RNA, 19 nt, Artificial Sequence
  Synthetic
ccuguagaacuaaauacaa

SEQ ID NO: 2063 - RNA, 19 nt, Artificial Sequence
  Synthetic
ucuauacuaauuuuacaac

SEQ ID NO: 2064 - RNA, 19 nt, Artificial Sequence
  Synthetic
ccuaugaaugcuauacaau

SEQ ID NO: 2065 - RNA, 19 nt, Artificial Sequence
  Synthetic
aaauucccugcuccuucac

SEQ ID NO: 2066 - RNA, 19 nt, Artificial Sequence
  Synthetic
cuucuguaaauauaucuua

SEQ ID NO: 2067 - RNA, 19 nt, Artificial Sequence
  Synthetic
ucaauguugauauguccau

SEQ ID NO: 2068 - RNA, 19 nt, Artificial Sequence
  Synthetic
gucaaauuuucaccauaau

SEQ ID NO: 2069 - RNA, 19 nt, Artificial Sequence
  Synthetic
caaugaauguuguugguug

SEQ ID NO: 2070 - RNA, 19 nt, Artificial Sequence
  Synthetic
cugauagguucagcaaacu

SEQ ID NO: 2071 - RNA, 19 nt, Artificial Sequence
  Synthetic
auaauuuuacuccaguuga

SEQ ID NO: 2072 - RNA, 19 nt, Artificial Sequence
  Synthetic
uuauuaacugaggaacagu

SEQ ID NO: 2073 - RNA, 19 nt, Artificial Sequence
  Synthetic
uuuaauauaguuauauugu

SEQ ID NO: 2074 - RNA, 19 nt, Artificial Sequence
  Synthetic
uuagcauuuuguacuacau

SEQ ID NO: 2075 - RNA, 19 nt, Artificial Sequence
  Synthetic
guucuugauaguaucaauu

SEQ ID NO: 2076 - RNA, 19 nt, Artificial Sequence
  Synthetic
ggcaugaugaaauuuuugg

SEQ ID NO: 2077 - RNA, 19 nt, Artificial Sequence
  Synthetic
auauuugcaucaauagacu

SEQ ID NO: 2078 - RNA, 19 nt, Artificial Sequence
  Synthetic
aaggguaucaaacuuuuaa

SEQ ID NO: 2079 - RNA, 19 nt, Artificial Sequence
  Synthetic
guuauaggguaacaaagaa

SEQ ID NO: 2080 - RNA, 19 nt, Artificial Sequence
  Synthetic
guauuaauuccuuuuuuug

SEQ ID NO: 2081 - RNA, 19 nt, Artificial Sequence
  Synthetic
uuuaguuuugacaaugcag

SEQ ID NO: 2082 - RNA, 19 nt, Artificial Sequence
  Synthetic
ucuccacuaacaacacucu

SEQ ID NO: 2083 - RNA, 19 nt, Artificial Sequence
  Synthetic
auagaauaugauaguauau

SEQ ID NO: 2084 - RNA, 19 nt, Artificial Sequence
  Synthetic
auaaguuuauugcugaaaa

SEQ ID NO: 2085 - RNA, 19 nt, Artificial Sequence
  Synthetic
uucauaugcuuaugauuua

SEQ ID NO: 2086 - RNA, 19 nt, Artificial Sequence
  Synthetic
cugaaauuuaaaacaugau

SEQ ID NO: 2087 - RNA, 19 nt, Artificial Sequence
  Synthetic
uaguuuaguucuguugauc

SEQ ID NO: 2088 - RNA, 19 nt, Artificial Sequence
  Synthetic
uaaggauauguagauucua

SEQ ID NO: 2089 - RNA, 19 nt, Artificial Sequence
  Synthetic
uuaaucaguuuuuuaaguu

SEQ ID NO: 2090 - RNA, 19 nt, Artificial Sequence
  Synthetic
ucauuaugaaaguuguaua

SEQ ID NO: 2091 - RNA, 19 nt, Artificial Sequence
  Synthetic
gucaaaaacuaauaucucg

SEQ ID NO: 2092 - RNA, 19 nt, Artificial Sequence
  Synthetic
guuguacgcauuuuuucgc

SEQ ID NO: 2093 - RNA, 19 nt, Artificial Sequence
  Synthetic
cuuuuaucauacucaauga

SEQ ID NO: 2094 - RNA, 19 nt, Artificial Sequence
  Synthetic
uauuauuauuagggcaaau

SEQ ID NO: 2095 - RNA, 19 nt, Artificial Sequence
  Synthetic
ugguguuagugacauugau

SEQ ID NO: 2096 - RNA, 19 nt, Artificial Sequence
  Synthetic
ugaauugauuuauuugccc

SEQ ID NO: 2097 - RNA, 19 nt, Artificial Sequence
  Synthetic
auuuaucaaguauauaaau

SEQ ID NO: 2098 - RNA, 19 nt, Artificial Sequence
  Synthetic
uaauuuuaaauuacuauaa

SEQ ID NO: 2099 - RNA, 19 nt, Artificial Sequence
  Synthetic
aaucaggagagucaugccu

SEQ ID NO: 2100 - RNA, 19 nt, Artificial Sequence
  Synthetic
cugcugcuaauuugguuau

SEQ ID NO: 2101 - RNA, 19 nt, Artificial Sequence
  Synthetic
ugguagaagauugugcuau

SEQ ID NO: 2102 - RNA, 19 nt, Artificial Sequence
  Synthetic
acaucacuugcccugcacc

SEQ ID NO: 2103 - RNA, 19 nt, Artificial Sequence
  Synthetic
cuacacuggagaagugagg

SEQ ID NO: 2104 - RNA, 19 nt, Artificial Sequence
  Synthetic
gauucuaggaauuugguag

SEQ ID NO: 2105 - RNA, 19 nt, Artificial Sequence
  Synthetic
auauuaucguuugucugau

SEQ ID NO: 2106 - RNA, 19 nt, Artificial Sequence
  Synthetic
cuaucuaaucuugcuguua

SEQ ID NO: 2107 - RNA, 19 nt, Artificial Sequence
  Synthetic
cuuauaccaucccgagcag

SEQ ID NO: 2108 - RNA, 19 nt, Artificial Sequence
  Synthetic
ucaucgucuuuuucuaaga

SEQ ID NO: 2109 - RNA, 19 nt, Artificial Sequence
  Synthetic
gcuagcacugcacuucuug

SEQ ID NO: 2110 - RNA, 19 nt, Artificial Sequence
  Synthetic
cuuuguggcuuuauguauu

SEQ ID NO: 2111 - RNA, 19 nt, Artificial Sequence
  Synthetic
agaucuacuauaaauugac

SEQ ID NO: 2112 - RNA, 19 nt, Artificial Sequence
  Synthetic
uuuuauuaacuuauuugag

SEQ ID NO: 2113 - RNA, 19 nt, Artificial Sequence
  Synthetic
gauuuccuccaaugauuau

SEQ ID NO: 2114 - RNA, 19 nt, Artificial Sequence
  Synthetic
aguauugcaaucaugaugg

SEQ ID NO: 2115 - RNA, 19 nt, Artificial Sequence
  Synthetic
caauuauaagugaaguuga

SEQ ID NO: 2116 - RNA, 19 nt, Artificial Sequence
  Synthetic
cuaugaauaugauggcugc

SEQ ID NO: 2117 - RNA, 19 nt, Artificial Sequence
  Synthetic
gggugagguauguuggggu

SEQ ID NO: 2118 - RNA, 19 nt, Artificial Sequence
  Synthetic
uggauugcaggguugacuu

SEQ ID NO: 2119 - RNA, 19 nt, Artificial Sequence
  Synthetic
uuuuggucuugacuguugu

SEQ ID NO: 2120 - RNA, 19 nt, Artificial Sequence
  Synthetic
uuuggcguuguuuuguggu

SEQ ID NO: 2121 - RNA, 19 nt, Artificial Sequence
  Synthetic
caaaguugaacacuucaaa

SEQ ID NO: 2122 - RNA, 19 nt, Artificial Sequence
  Synthetic
uugguuuuuuugugggcuu

SEQ ID NO: 2123 - RNA, 19 nt, Artificial Sequence
  Synthetic
cuuauuuuccuugauauua

SEQ ID NO: 2124 - RNA, 19 nt, Artificial Sequence
  Synthetic
uuuuaucaauuuuaccuua

SEQ ID NO: 2125 - RNA, 19 nt, Artificial Sequence
  Synthetic
auauuuaucuaauucuugu

SEQ ID NO: 2126 - RNA, 19 nt, Artificial Sequence
  Synthetic
cacuuccccuucuaggugc

SEQ ID NO: 2127 - RNA, 19 nt, Artificial Sequence
  Synthetic
ugauaagcugacuacagcc

SEQ ID NO: 2128 - RNA, 19 nt, Artificial Sequence
  Synthetic
uaagacacuaacuccauuu

SEQ ID NO: 2129 - RNA, 19 nt, Artificial Sequence
  Synthetic
uuggaacucuaucacaguu

SEQ ID NO: 2130 - RNA, 19 nt, Artificial Sequence
  Synthetic
accugcauuaacacuaaau

SEQ ID NO: 2131 - RNA, 19 nt, Artificial Sequence
  Synthetic
gcuuacagguguaguuaca

SEQ ID NO: 2132 - RNA, 19 nt, Artificial Sequence
  Synthetic
aucauauuugggguugaau

SEQ ID NO: 2133 - RNA, 19 nt, Artificial Sequence
  Synthetic
aucgcacccguuagaaaau

SEQ ID NO: 2134 - RNA, 19 nt, Artificial Sequence
  Synthetic
aauaaaugcuaggcucugg

SEQ ID NO: 2135 - RNA, 19 nt, Artificial Sequence
  Synthetic
agcauuuacauuauguaau

SEQ ID NO: 2136 - RNA, 19 nt, Artificial Sequence
  Synthetic
uauuuuuauuuaguuacua

SEQ ID NO: 2137 - RNA, 19 nt, Artificial Sequence
  Synthetic
ugguuuauagaugagaguu

SEQ ID NO: 2138 - RNA, 19 nt, Artificial Sequence
  Synthetic
ugacauauuugccccaguu

SEQ ID NO: 2139 - RNA, 19 nt, Artificial Sequence
  Synthetic
auuaugacuaaaaugacac

SEQ ID NO: 2140 - RNA, 19 nt, Artificial Sequence
  Synthetic
ucuuacaagcagugcaugg

SEQ ID NO: 2141 - RNA, 19 nt, Artificial Sequence
  Synthetic
acuaacaguugauucuuuu

SEQ ID NO: 2142 - RNA, 19 nt, Artificial Sequence
  Synthetic
uuuugauuauacauaguaa

SEQ ID NO: 2143 - RNA, 19 nt, Artificial Sequence
  Synthetic
ucuugagagguccaaugga

SEQ ID NO: 2144 - RNA, 19 nt, Artificial Sequence
  Synthetic
agauguuguagaaaauuuu

SEQ ID NO: 2145 - RNA, 19 nt, Artificial Sequence
  Synthetic
gacugaaaauaaguagguu

SEQ ID NO: 2146 - RNA, 19 nt, Artificial Sequence
  Synthetic
uugucuucaucuuguccau

SEQ ID NO: 2147 - RNA, 19 nt, Artificial Sequence
  Synthetic
aauccgcaucuuaagccua

SEQ ID NO: 2148 - RNA, 19 nt, Artificial Sequence
  Synthetic
gauagcagauuuuucugag

SEQ ID NO: 2149 - RNA, 19 nt, Artificial Sequence
  Synthetic
ucauguucuauauaauuuu

SEQ ID NO: 2150 - RNA, 19 nt, Artificial Sequence
  Synthetic
auuccugcuuucaauucua

SEQ ID NO: 2151 - RNA, 19 nt, Artificial Sequence
  Synthetic
ccuuuuaauuuguggccua

SEQ ID NO: 2152 - RNA, 19 nt, Artificial Sequence
  Synthetic
acuuucuuuauacuagcug

SEQ ID NO: 2153 - RNA, 19 nt, Artificial Sequence
  Synthetic
cauaaugcaugauuuuuua

SEQ ID NO: 2154 - RNA, 19 nt, Artificial Sequence
  Synthetic
agaucuugaaguuuaucuu

SEQ ID NO: 2155 - RNA, 19 nt, Artificial Sequence
  Synthetic
agucuauugauuucgcuag

SEQ ID NO: 2156 - RNA, 19 nt, Artificial Sequence
  Synthetic
guggguccucucucaccac

SEQ ID NO: 2157 - RNA, 19 nt, Artificial Sequence
  Synthetic
auuugaucucucuguuuuu

SEQ ID NO: 2158 - RNA, 19 nt, Artificial Sequence
  Synthetic
ccagauuugaguguuuuau

SEQ ID NO: 2159 - RNA, 19 nt, Artificial Sequence
  Synthetic
uguauaaucagaauccaau

SEQ ID NO: 2160 - RNA, 19 nt, Artificial Sequence
  Synthetic
augaacauaugaucaguua

SEQ ID NO: 2161 - RNA, 19 nt, Artificial Sequence
  Synthetic
uucauaucacacuccagcu

SEQ ID NO: 2162 - RNA, 19 nt, Artificial Sequence
  Synthetic
ucugcuacauuaagacguu

SEQ ID NO: 2163 - RNA, 19 nt, Artificial Sequence
  Synthetic
caagggcaaacugugaauu

SEQ ID NO: 2164 - RNA, 19 nt, Artificial Sequence
  Synthetic
ucagaauuagcaauccuua

SEQ ID NO: 2165 - RNA, 19 nt, Artificial Sequence
  Synthetic
caauagucauucagugucu

SEQ ID NO: 2166 - RNA, 19 nt, Artificial Sequence
  Synthetic
uuauacaaaucuuguuugc

SEQ ID NO: 2167 - RNA, 19 nt, Artificial Sequence
  Synthetic
gcuguauuaccugaaugau

SEQ ID NO: 2168 - RNA, 19 nt, Artificial Sequence
  Synthetic
uuguacagccuuaaaaacu

SEQ ID NO: 2169 - RNA, 19 nt, Artificial Sequence
  Synthetic
gcaucacagacaaaaagac

SEQ ID NO: 2170 - RNA, 19 nt, Artificial Sequence
  Synthetic
ccuaagcauacauaaguuu

SEQ ID NO: 2171 - RNA, 19 nt, Artificial Sequence
  Synthetic
aggacuaaguaaacuucag

SEQ ID NO: 2172 - RNA, 19 nt, Artificial Sequence
  Synthetic
uugaaccauuuuaagaugu

SEQ ID NO: 2173 - RNA, 19 nt, Artificial Sequence
  Synthetic
ugauggugaagugaagaau

SEQ ID NO: 2174 - RNA, 19 nt, Artificial Sequence
  Synthetic
ucugcuugagcaugaguuu

SEQ ID NO: 2175 - RNA, 19 nt, Artificial Sequence
  Synthetic
acuacuguacgcaauaaua

SEQ ID NO: 2176 - RNA, 19 nt, Artificial Sequence
  Synthetic
ucauuuauuucuucauaug

SEQ ID NO: 2177 - RNA, 19 nt, Artificial Sequence
  Synthetic
auuuaugguggauuuacca

SEQ ID NO: 2178 - RNA, 19 nt, Artificial Sequence
  Synthetic
uuugguuuacgcaaguuug

SEQ ID NO: 2179 - RNA, 19 nt, Artificial Sequence
  Synthetic
uuaauuugucaguauagca

SEQ ID NO: 2180 - RNA, 19 nt, Artificial Sequence
  Synthetic
caucagucuuuguggugug

SEQ ID NO: 2181 - RNA, 19 nt, Artificial Sequence
  Synthetic
ucuguguguuaugaugucu

SEQ ID NO: 2182 - RNA, 19 nt, Artificial Sequence
  Synthetic
uguugaaauucauggauug

SEQ ID NO: 2183 - RNA, 19 nt, Artificial Sequence
  Synthetic
uaagaccagaucuaucccc

SEQ ID NO: 2184 - RNA, 19 nt, Artificial Sequence
  Synthetic
agaagcuguuggcuauauc

SEQ ID NO: 2185 - RNA, 19 nt, Artificial Sequence
  Synthetic
uauuuuuaacugauuuugc

SEQ ID NO: 2186 - RNA, 19 nt, Artificial Sequence
  Synthetic
cugucaagucuaauacacu

SEQ ID NO: 2187 - RNA, 19 nt, Artificial Sequence
  Synthetic
uugggaucuuuaggugaug

SEQ ID NO: 2188 - RNA, 19 nt, Artificial Sequence
  Synthetic
aguuuugaaaagggauuau

SEQ ID NO: 2189 - RNA, 19 nt, Artificial Sequence
  Synthetic
gaauagcuagauucuucuu

SEQ ID NO: 2190 - RNA, 19 nt, Artificial Sequence
  Synthetic
gcuacuacuaaugugugaa

SEQ ID NO: 2191 - RNA, 19 nt, Artificial Sequence
  Synthetic
aacagguuguucaauuucu

SEQ ID NO: 2192 - RNA, 19 nt, Artificial Sequence
  Synthetic
gucuucuguugguguugug

SEQ ID NO: 2193 - RNA, 19 nt, Artificial Sequence
  Synthetic
uuaacuguaguuaacauau

SEQ ID NO: 2194 - RNA, 19 nt, Artificial Sequence
  Synthetic
ccccaacguuauuguuagu

SEQ ID NO: 2195 - RNA, 19 nt, Artificial Sequence
  Synthetic
ugagagugucccaggucuu

SEQ ID NO: 2196 - RNA, 19 nt, Artificial Sequence
  Synthetic
cuauagauuuaagauuuaa

SEQ ID NO: 2197 - RNA, 19 nt, Artificial Sequence
  Synthetic
uugcaguuguuagugugac

SEQ ID NO: 2198 - RNA, 19 nt, Artificial Sequence
  Synthetic
acagauuggagaagcugau

SEQ ID NO: 2199 - RNA, 19 nt, Artificial Sequence
  Synthetic
aagcuaguauggugguggu

SEQ ID NO: 2200 - RNA, 19 nt, Artificial Sequence
  Synthetic
guuuguuuggugguuuguu

SEQ ID NO: 2201 - RNA, 19 nt, Artificial Sequence
  Synthetic
ugguggugguuuucuuucc

SEQ ID NO: 2202 - RNA, 19 nt, Artificial Sequence
  Synthetic
uuugagguuugagaucuuu

SEQ ID NO: 2203 - RNA, 19 nt, Artificial Sequence
  Synthetic
aguucuuagagcacuaaga

SEQ ID NO: 2204 - RNA, 19 nt, Artificial Sequence
  Synthetic
aacacuaguauaccaacca

SEQ ID NO: 2205 - RNA, 19 nt, Artificial Sequence
  Synthetic
gguauuguugaguguauaa

SEQ ID NO: 2206 - RNA, 19 nt, Artificial Sequence
  Synthetic
aaugccacuggcgauugca

SEQ ID NO: 2207 - RNA, 19 nt, Artificial Sequence
  Synthetic
cgauugaacuuuacauguu

SEQ ID NO: 2208 - RNA, 19 nt, Artificial Sequence
  Synthetic
gucacaaaauacucgauuc

SEQ ID NO: 2209 - RNA, 19 nt, Artificial Sequence
  Synthetic
gccuucuugcuuauuuaca

SEQ ID NO: 2210 - RNA, 19 nt, Artificial Sequence
  Synthetic
uuuuacauagagacuuuug

SEQ ID NO: 2211 - RNA, 19 nt, Artificial Sequence
  Synthetic
guuaaucuucucauugacu

SEQ ID NO: 2212 - RNA, 19 nt, Artificial Sequence
  Synthetic
accacucaguugauccuug

SEQ ID NO: 2213 - RNA, 19 nt, Artificial Sequence
  Synthetic
uuaagaaaauccaaugaua

SEQ ID NO: 2214 - RNA, 19 nt, Artificial Sequence
  Synthetic
guaaguuaaucugguauuc

SEQ ID NO: 2215 - RNA, 19 nt, Artificial Sequence
  Synthetic
auugaacacauuaauuucu

SEQ ID NO: 2216 - RNA, 19 nt, Artificial Sequence
  Synthetic
uuuaauuuuguguauaaau

SEQ ID NO: 2217 - RNA, 19 nt, Artificial Sequence
  Synthetic
caaccauauugauucaaaa

SEQ ID NO: 2218 - RNA, 19 nt, Artificial Sequence
  Synthetic
gauacugucuuaucuaaua

SEQ ID NO: 2219 - RNA, 19 nt, Artificial Sequence
  Synthetic
aacauacucaaacugcuua

SEQ ID NO: 2220 - RNA, 19 nt, Artificial Sequence
  Synthetic
uguaugugugacggcauau

SEQ ID NO: 2221 - RNA, 19 nt, Artificial Sequence
  Synthetic
ucucuuauauaggggggug

SEQ ID NO: 2222 - RNA, 19 nt, Artificial Sequence
  Synthetic
aaauauaauuuauuguuac

SEQ ID NO: 2223 - RNA, 19 nt, Artificial Sequence
  Synthetic
ucugugaggaaaucaggag

SEQ ID NO: 2224 - RNA, 19 nt, Artificial Sequence
  Synthetic
ccgugaggauauguagguu

SEQ ID NO: 2225 - RNA, 19 nt, Artificial Sequence
  Synthetic
auggcagaagucuuuucca

SEQ ID NO: 2226 - RNA, 19 nt, Artificial Sequence
  Synthetic
cuuguuguauauuugaugu

SEQ ID NO: 2227 - RNA, 19 nt, Artificial Sequence
  Synthetic
augccacuagcuauagugc

SEQ ID NO: 2228 - RNA, 19 nt, Artificial Sequence
  Synthetic
uauuguggaaauaauuuuu

SEQ ID NO: 2229 - RNA, 19 nt, Artificial Sequence
  Synthetic
gacauuaagcuaaggccaa

SEQ ID NO: 2230 - RNA, 19 nt, Artificial Sequence
  Synthetic
uuauaauuaauguaaaaga

SEQ ID NO: 2231 - RNA, 19 nt, Artificial Sequence
  Synthetic
auauguuuaguuaauagau

SEQ ID NO: 2232 - RNA, 19 nt, Artificial Sequence
  Synthetic
caauaaagugaugugcuau

SEQ ID NO: 2233 - RNA, 19 nt, Artificial Sequence
  Synthetic
aggucuuuuaaaauauacu

SEQ ID NO: 2234 - RNA, 19 nt, Artificial Sequence
  Synthetic
uacuugcauuuucuuacau

SEQ ID NO: 2235 - RNA, 19 nt, Artificial Sequence
  Synthetic
uuuacuauuaacguacauu

SEQ ID NO: 2236 - RNA, 19 nt, Artificial Sequence
  Synthetic
uuugcaggaccuauuguaa

SEQ ID NO: 2237 - RNA, 19 nt, Artificial Sequence
  Synthetic
ucauuaguugucaagcugu

SEQ ID NO: 2238 - RNA, 19 nt, Artificial Sequence
  Synthetic
uccuagaucaaaaugauaa

SEQ ID NO: 2239 - RNA, 19 nt, Artificial Sequence
  Synthetic
uuugcuaguugauauuuau

SEQ ID NO: 2240 - RNA, 19 nt, Artificial Sequence
  Synthetic
ccauuuuuaucuucuguca

SEQ ID NO: 2241 - RNA, 19 nt, Artificial Sequence
  Synthetic
guccaugguugggucggcu

SEQ ID NO: 2242 - RNA, 19 nt, Artificial Sequence
  Synthetic
ggugucauuguguguugug

SEQ ID NO: 2243 - RNA, 19 nt, Artificial Sequence
  Synthetic
uggucucaugucugugauc

SEQ ID NO: 2244 - RNA, 19 nt, Artificial Sequence
  Synthetic
uauagucucaagugacaau

SEQ ID NO: 2245 - RNA, 19 nt, Artificial Sequence
  Synthetic
ucugguuagugauauuauu

SEQ ID NO: 2246 - RNA, 19 nt, Artificial Sequence
  Synthetic
ucucacuauacauucauga

SEQ ID NO: 2247 - RNA, 19 nt, Artificial Sequence
  Synthetic
ucccacuuugugcaauagu

SEQ ID NO: 2248 - RNA, 19 nt, Artificial Sequence
  Synthetic
uuuuuuguauuuagugcuu

SEQ ID NO: 2249 - RNA, 19 nt, Artificial Sequence
  Synthetic
aggaaaagugccauauuuu

SEQ ID NO: 2250 - RNA, 19 nt, Artificial Sequence
  Synthetic
auugauaaauauuggcaua

SEQ ID NO: 2251 - RNA, 19 nt, Artificial Sequence
  Synthetic
uaugggagugugcuuugua

SEQ ID NO: 2252 - RNA, 19 nt, Artificial Sequence
  Synthetic
cagauugugugacucuugu

SEQ ID NO: 2253 - RNA, 19 nt, Artificial Sequence
  Synthetic
ugcaugaaguuguuauuuc

SEQ ID NO: 2254 - RNA, 19 nt, Artificial Sequence
  Synthetic
aacuauggagugugguuau

SEQ ID NO: 2255 - RNA, 19 nt, Artificial Sequence
  Synthetic
auuuucaggcuccauuuga

SEQ ID NO: 2256 - RNA, 19 nt, Artificial Sequence
  Synthetic
ucaucuuaugucucuccuu

SEQ ID NO: 2257 - RNA, 19 nt, Artificial Sequence
  Synthetic
uuguauuugccccaucuuu

SEQ ID NO: 2258 - RNA, 19 nt, Artificial Sequence
  Synthetic
cuuugcuaagagccauuuu

SEQ ID NO: 2259 - RNA, 19 nt, Artificial Sequence
  Synthetic
cuucucuuccuaaucuaga

SEQ ID NO: 2260 - RNA, 19 nt, Artificial Sequence
  Synthetic
ccacuccauuugcuuuuac

SEQ ID NO: 2261 - RNA, 19 nt, Artificial Sequence
  Synthetic
uuaagcuugacaauguuaa

SEQ ID NO: 2262 - RNA, 19 nt, Artificial Sequence
  Synthetic
uuacuaaugccgcuauaca

SEQ ID NO: 2263 - RNA, 19 nt, Artificial Sequence
  Synthetic
cccuccuaaucacagcugu

SEQ ID NO: 2264 - RNA, 19 nt, Artificial Sequence
  Synthetic
uauaacguuucauuucauu

SEQ ID NO: 2265 - RNA, 19 nt, Artificial Sequence
  Synthetic
auuuuucaaacacuucaua

SEQ ID NO: 2266 - RNA, 19 nt, Artificial Sequence
  Synthetic
caucuauaaagugaggaua

SEQ ID NO: 2267 - RNA, 19 nt, Artificial Sequence
  Synthetic
auccagcaaaaaucccuuc

SEQ ID NO: 2268 - RNA, 19 nt, Artificial Sequence
  Synthetic
cuaagaccccccaccguaa

SEQ ID NO: 2269 - RNA, 19 nt, Artificial Sequence
  Synthetic
uagcguguccuagcauaau

SEQ ID NO: 2270 - RNA, 19 nt, Artificial Sequence
  Synthetic
aaaccuccacaacuuguuc

SEQ ID NO: 2271 - RNA, 19 nt, Artificial Sequence
  Synthetic
acccugcuucuccacccaa

SEQ ID NO: 2272 - RNA, 19 nt, Artificial Sequence
  Synthetic
gaaauugagucaaagacaa

SEQ ID NO: 2273 - RNA, 19 nt, Artificial Sequence
  Synthetic
uugguguaccucuguauuc

SEQ ID NO: 2274 - RNA, 19 nt, Artificial Sequence
  Synthetic
cauaugcuuuugcagcauc

SEQ ID NO: 2275 - RNA, 19 nt, Artificial Sequence
  Synthetic
gcucuguuguuugcaucuu

SEQ ID NO: 2276 - RNA, 19 nt, Artificial Sequence
  Synthetic
ggguuuauaaugguugaau

SEQ ID NO: 2277 - RNA, 19 nt, Artificial Sequence
  Synthetic
ggcuuguucccuacaguau

SEQ ID NO: 2278 - RNA, 19 nt, Artificial Sequence
  Synthetic
ucacuuggcguagggucuu

SEQ ID NO: 2279 - RNA, 19 nt, Artificial Sequence
  Synthetic
gauguagguccugcacucg

SEQ ID NO: 2280 - RNA, 19 nt, Artificial Sequence
  Synthetic
cuugccauagcuucuaguc

SEQ ID NO: 2281 - RNA, 19 nt, Artificial Sequence
  Synthetic
guaacugaucagaaaucau

SEQ ID NO: 2282 - RNA, 19 nt, Artificial Sequence
  Synthetic
guguugauguacagauugg

SEQ ID NO: 2283 - RNA, 19 nt, Artificial Sequence
  Synthetic
gaguugguuuguuuguugg

SEQ ID NO: 2284 - RNA, 19 nt, Artificial Sequence
  Synthetic
auguuugguuggaugggug

SEQ ID NO: 2285 - RNA, 19 nt, Artificial Sequence
  Synthetic
uggcugauuggcguauaga

SEQ ID NO: 2286 - RNA, 19 nt, Artificial Sequence
  Synthetic
ggguggcuaguuuuggauu

SEQ ID NO: 2287 - RNA, 19 nt, Artificial Sequence
  Synthetic
auaguaucuauuuuuuccg

SEQ ID NO: 2288 - RNA, 19 nt, Artificial Sequence
  Synthetic
ccaucuuuuuuuguaacua

SEQ ID NO: 2289 - RNA, 19 nt, Artificial Sequence
  Synthetic
ucgugaaguuuguucacgu

SEQ ID NO: 2290 - RNA, 19 nt, Artificial Sequence
  Synthetic
ucugcuggcauggaugauu

SEQ ID NO: 2291 - RNA, 19 nt, Artificial Sequence
  Synthetic
acauuggcacauaugguaa

SEQ ID NO: 2292 - RNA, 19 nt, Artificial Sequence
  Synthetic
acaucauaugccagcuugc

SEQ ID NO: 2293 - RNA, 19 nt, Artificial Sequence
  Synthetic
guuuucauagugagaucuu

SEQ ID NO: 2294 - RNA, 19 nt, Artificial Sequence
  Synthetic
ucauguguuggguugagug

SEQ ID NO: 2295 - RNA, 19 nt, Artificial Sequence
  Synthetic
ucacauaaagcaaugaugu

SEQ ID NO: 2296 - RNA, 19 nt, Artificial Sequence
  Synthetic
guuacuauauuuucaaauu

SEQ ID NO: 2297 - RNA, 19 nt, Artificial Sequence
  Synthetic
gugauggcauuuuugaauu

SEQ ID NO: 2298 - RNA, 19 nt, Artificial Sequence
  Synthetic
aacaguaauccugaguaag

SEQ ID NO: 2299 - RNA, 19 nt, Artificial Sequence
  Synthetic
ugcuuccaauuuguuguaa

SEQ ID NO: 2300 - RNA, 19 nt, Artificial Sequence
  Synthetic
guagaagaaaaagguuaau

SEQ ID NO: 2301 - RNA, 19 nt, Artificial Sequence
  Synthetic
augaaucaacucacugaug

SEQ ID NO: 2302 - RNA, 19 nt, Artificial Sequence
  Synthetic
acagaggguuggugauuau

SEQ ID NO: 2303 - RNA, 19 nt, Artificial Sequence
  Synthetic
uguuugauuaguugaacca

SEQ ID NO: 2304 - RNA, 19 nt, Artificial Sequence
  Synthetic
gaggcuccagauggguuuu

SEQ ID NO: 2305 - RNA, 19 nt, Artificial Sequence
  Synthetic
guacuagaucugaugaaca

SEQ ID NO: 2306 - RNA, 19 nt, Artificial Sequence
  Synthetic
uuugccccauguggauauu

SEQ ID NO: 2307 - RNA, 19 nt, Artificial Sequence
  Synthetic
ugacuugucuauguugaca

SEQ ID NO: 2308 - RNA, 19 nt, Artificial Sequence
  Synthetic
gagauuauuguuguuauca

SEQ ID NO: 2309 - RNA, 19 nt, Artificial Sequence
  Synthetic
cuugguagcucaaagguuu

SEQ ID NO: 2310 - RNA, 19 nt, Artificial Sequence
  Synthetic
uauguauugacucgagcuc

SEQ ID NO: 2311 - RNA, 19 nt, Artificial Sequence
  Synthetic
caucagauuggugaaugcu

SEQ ID NO: 2312 - RNA, 19 nt, Artificial Sequence
  Synthetic
aagguuacuguuuugugcc

SEQ ID NO: 2313 - RNA, 19 nt, Artificial Sequence
  Synthetic
uuguucacuuacaaaugca

SEQ ID NO: 2314 - RNA, 19 nt, Artificial Sequence
  Synthetic
uuuguaaagaggugagggu

SEQ ID NO: 2315 - RNA, 19 nt, Artificial Sequence
  Synthetic
gugagauguugaugugguu

SEQ ID NO: 2316 - RNA, 19 nt, Artificial Sequence
  Synthetic
uggaugauggcuugcaugg

SEQ ID NO: 2317 - RNA, 19 nt, Artificial Sequence
  Synthetic
auuaacuacuuuauaauau

SEQ ID NO: 2318 - RNA, 19 nt, Artificial Sequence
  Synthetic
uuguuaugauuauuuuuaa

SEQ ID NO: 2319 - RNA, 19 nt, Artificial Sequence
  Synthetic
ucuuaauaucuuaguucau

SEQ ID NO: 2320 - RNA, 19 nt, Artificial Sequence
  Synthetic
auaugaauaauagaugauu

SEQ ID NO: 2321 - RNA, 19 nt, Artificial Sequence
  Synthetic
acuuguauaagcacgauga

SEQ ID NO: 2322 - RNA, 19 nt, Artificial Sequence
  Synthetic
uuccaagcuggggauucug

SEQ ID NO: 2323 - RNA, 19 nt, Artificial Sequence
  Synthetic
uuugugauguaguuucaga

SEQ ID NO: 2324 - RNA, 19 nt, Artificial Sequence
  Synthetic
ugacacuugguguuguuga

SEQ ID NO: 2325 - RNA, 19 nt, Artificial Sequence
  Synthetic
uuuugguuguuguuguguu

SEQ ID NO: 2326 - RNA, 19 nt, Artificial Sequence
  Synthetic
ugggcuugcuggguuguau

SEQ ID NO: 2327 - RNA, 19 nt, Artificial Sequence
  Synthetic
ugcauaugcugcaagguac

SEQ ID NO: 2328 - RNA, 19 nt, Artificial Sequence
  Synthetic
uucuuuuacagauagccca

SEQ ID NO: 2329 - RNA, 19 nt, Artificial Sequence
  Synthetic
cagguuuuuuguuugguau

SEQ ID NO: 2330 - RNA, 19 nt, Artificial Sequence
  Synthetic
uuuugguugucuugauggu

SEQ ID NO: 2331 - RNA, 19 nt, Artificial Sequence
  Synthetic
cuuccuuugguuuuguggu

SEQ ID NO: 2332 - RNA, 19 nt, Artificial Sequence
  Synthetic
ugggcuuggugguagguac

SEQ ID NO: 2333 - RNA, 19 nt, Artificial Sequence
  Synthetic
ugaugguuggcuuuucugu

SEQ ID NO: 2334 - RNA, 19 nt, Artificial Sequence
  Synthetic
ugagcaguguaguucugau

SEQ ID NO: 2335 - RNA, 19 nt, Artificial Sequence
  Synthetic
uuccugugguauuguuggu

SEQ ID NO: 2336 - RNA, 19 nt, Artificial Sequence
  Synthetic
gacuuguguguucuggauu

SEQ ID NO: 2337 - RNA, 19 nt, Artificial Sequence
  Synthetic
aguggaggguucccuuuug

SEQ ID NO: 2338 - RNA, 19 nt, Artificial Sequence
  Synthetic
ugccaucggaggagguuga

SEQ ID NO: 2339 - RNA, 19 nt, Artificial Sequence
  Synthetic
cuugugaagggcuuggauu

SEQ ID NO: 2340 - RNA, 19 nt, Artificial Sequence
  Synthetic
acucggauguuguauagac

SEQ ID NO: 2341 - RNA, 19 nt, Artificial Sequence
  Synthetic
auggagguugugauaggua

SEQ ID NO: 2342 - RNA, 19 nt, Artificial Sequence
  Synthetic
uuguuguguuggauggaga

SEQ ID NO: 2343 - RNA, 19 nt, Artificial Sequence
  Synthetic
uuuuuaaugacuacugguu

SEQ ID NO: 2344 - RNA, 19 nt, Artificial Sequence
  Synthetic
cuuuuugcaauaauacgcu

SEQ ID NO: 2345 - RNA, 19 nt, Artificial Sequence
  Synthetic
ugguugauuuggucauggc

SEQ ID NO: 2346 - RNA, 19 nt, Artificial Sequence
  Synthetic
cagaguugauuuugauucu

SEQ ID NO: 2347 - RNA, 19 nt, Artificial Sequence
  Synthetic
uguuuugaggauuggcaac

SEQ ID NO: 2348 - RNA, 19 nt, Artificial Sequence
  Synthetic
gauugcgguaauugcauuu

SEQ ID NO: 2349 - RNA, 19 nt, Artificial Sequence
  Synthetic
gagugugacugcagcaagg

SEQ ID NO: 2350 - RNA, 19 nt, Artificial Sequence
  Synthetic
uugacuggaagcaaaacag

SEQ ID NO: 2351 - RNA, 19 nt, Artificial Sequence
  Synthetic
auagccuuugcugacugca

SEQ ID NO: 2352 - RNA, 19 nt, Artificial Sequence
  Synthetic
uucuguuacagcacuuuua

SEQ ID NO: 2353 - RNA, 19 nt, Artificial Sequence
  Synthetic
guugguugccggugugcuu

SEQ ID NO: 2354 - RNA, 19 nt, Artificial Sequence
  Synthetic
uguuacauugguauuuuug

SEQ ID NO: 2355 - RNA, 19 nt, Artificial Sequence
  Synthetic
aaagccaagaaaucuucuu

SEQ ID NO: 2356 - RNA, 19 nt, Artificial Sequence
  Synthetic
aauagguaacaacuguuua

SEQ ID NO: 2357 - RNA, 19 nt, Artificial Sequence
  Synthetic
acagcuuugcuuguucaca

SEQ ID NO: 2358 - RNA, 19 nt, Artificial Sequence
  Synthetic
uucaauguuugauaugcua

SEQ ID NO: 2359 - RNA, 19 nt, Artificial Sequence
  Synthetic
auuuguuaacauauaagug

SEQ ID NO: 2360 - RNA, 19 nt, Artificial Sequence
  Synthetic
uaaugauaauaauucacua

SEQ ID NO: 2361 - RNA, 19 nt, Artificial Sequence
  Synthetic
gacuuccuccuuuauuaug

SEQ ID NO: 2362 - RNA, 19 nt, Artificial Sequence
  Synthetic
uacaccauauagugguaau

SEQ ID NO: 2363 - RNA, 19 nt, Artificial Sequence
  Synthetic
ccaacaagguguaucuauu

SEQ ID NO: 2364 - RNA, 19 nt, Artificial Sequence
  Synthetic
gauguuggacccuuccuuu

SEQ ID NO: 2365 - RNA, 19 nt, Artificial Sequence
  Synthetic
gucgguucuuguuaaacag

SEQ ID NO: 2366 - RNA, 19 nt, Artificial Sequence
  Synthetic
uucagcuagugggaagaaa

SEQ ID NO: 2367 - RNA, 19 nt, Artificial Sequence
  Synthetic
uaugucaauguugcagaga

SEQ ID NO: 2368 - RNA, 19 nt, Artificial Sequence
  Synthetic
ugaagucauaauuuugcaa

SEQ ID NO: 2369 - RNA, 19 nt, Artificial Sequence
  Synthetic
ccccuuauuugauacauaa

SEQ ID NO: 2370 - RNA, 19 nt, Artificial Sequence
  Synthetic
auaauauaauguauuaccu

SEQ ID NO: 2371 - RNA, 19 nt, Artificial Sequence
  Synthetic
cacuaaugggucauagaaa

SEQ ID NO: 2372 - RNA, 19 nt, Artificial Sequence
  Synthetic
aaauucaucagaggggaac

SEQ ID NO: 2373 - RNA, 19 nt, Artificial Sequence
  Synthetic
uaggagcaguccaacggca

SEQ ID NO: 2374 - RNA, 19 nt, Artificial Sequence
  Synthetic
gcuucuggccuugcaguau

SEQ ID NO: 2375 - RNA, 19 nt, Artificial Sequence
  Synthetic
cagauaugaaaccauugua

SEQ ID NO: 2376 - RNA, 19 nt, Artificial Sequence
  Synthetic
uaaauaauguaagugagau

SEQ ID NO: 2377 - RNA, 19 nt, Artificial Sequence
  Synthetic
caauuguuuuauauaacua

SEQ ID NO: 2378 - RNA, 19 nt, Artificial Sequence
  Synthetic
ucucauuuuuuacaaauag

SEQ ID NO: 2379 - RNA, 19 nt, Artificial Sequence
  Synthetic
ccucuuaccauucaagcaa

SEQ ID NO: 2380 - RNA, 19 nt, Artificial Sequence
  Synthetic
gagggcauacucuucuguu

SEQ ID NO: 2381 - RNA, 19 nt, Artificial Sequence
  Synthetic
uagcacuccaacuacaccg

SEQ ID NO: 2382 - RNA, 19 nt, Artificial Sequence
  Synthetic
agauccuauauaacucucu

SEQ ID NO: 2383 - RNA, 19 nt, Artificial Sequence
  Synthetic
uuuaguuauauuauuuaua

SEQ ID NO: 2384 - RNA, 19 nt, Artificial Sequence
  Synthetic
gucaucacuguugaguuca

SEQ ID NO: 2385 - RNA, 19 nt, Artificial Sequence
  Synthetic
gucccucaguuuuuugaug

SEQ ID NO: 2386 - RNA, 19 nt, Artificial Sequence
  Synthetic
ugaauuuggcucuucauug

SEQ ID NO: 2387 - RNA, 19 nt, Artificial Sequence
  Synthetic
ugugguuuuuaugguuuuc

SEQ ID NO: 2388 - RNA, 19 nt, Artificial Sequence
  Synthetic
gcucuuguggauauccaau

SEQ ID NO: 2389 - RNA, 19 nt, Artificial Sequence
  Synthetic
uggguuauugaugguuaug

SEQ ID NO: 2390 - RNA, 19 nt, Artificial Sequence
  Synthetic
ggcauggucguuuauauca

SEQ ID NO: 2391 - RNA, 19 nt, Artificial Sequence
  Synthetic
auuaguauggaauuuauac

SEQ ID NO: 2392 - RNA, 19 nt, Artificial Sequence
  Synthetic
acucuacaacuacuuguua

SEQ ID NO: 2393 - RNA, 19 nt, Artificial Sequence
  Synthetic
uuauuuugguuguuuugau

SEQ ID NO: 2394 - RNA, 19 nt, Artificial Sequence
  Synthetic
uucggugaguauauauggu

SEQ ID NO: 2395 - RNA, 19 nt, Artificial Sequence
  Synthetic
auuucauugaaugguugau

SEQ ID NO: 2396 - RNA, 19 nt, Artificial Sequence
  Synthetic
ugaauugcaucaaucaagu

SEQ ID NO: 2397 - RNA, 19 nt, Artificial Sequence
  Synthetic
auaucaucaguaauaccua

SEQ ID NO: 2398 - RNA, 19 nt, Artificial Sequence
  Synthetic
aauauauauauuguguaua

SEQ ID NO: 2399 - RNA, 19 nt, Artificial Sequence
  Synthetic
gaugugguaagcauuagga

SEQ ID NO: 2400 - RNA, 19 nt, Artificial Sequence
  Synthetic
uugaguuaauaguuugaug

SEQ ID NO: 2401 - RNA, 19 nt, Artificial Sequence
  Synthetic
ucccauggcuugaauuguu

SEQ ID NO: 2402 - RNA, 19 nt, Artificial Sequence
  Synthetic
cuaucgguuagauacacau

SEQ ID NO: 2403 - RNA, 19 nt, Artificial Sequence
  Synthetic
uuacauucugagaaagaaa

SEQ ID NO: 2404 - RNA, 19 nt, Artificial Sequence
  Synthetic
uuuaguuucuuuagauuua

SEQ ID NO: 2405 - RNA, 19 nt, Artificial Sequence
  Synthetic
ucuucuauuuuuauuucac

SEQ ID NO: 2406 - RNA, 19 nt, Artificial Sequence
  Synthetic
ucuaacgaggucauacucu

SEQ ID NO: 2407 - RNA, 19 nt, Artificial Sequence
  Synthetic
uuagugguaguaaucuguu

SEQ ID NO: 2408 - RNA, 19 nt, Artificial Sequence
  Synthetic
uagacuuugacaucacuaa

SEQ ID NO: 2409 - RNA, 19 nt, Artificial Sequence
  Synthetic
ucuuuuucuuuaagcccca

SEQ ID NO: 2410 - RNA, 19 nt, Artificial Sequence
  Synthetic
augguuguaauaacugagu

SEQ ID NO: 2411 - RNA, 19 nt, Artificial Sequence
  Synthetic
uuauccuuaacagcuaaaa

SEQ ID NO: 2412 - RNA, 19 nt, Artificial Sequence
  Synthetic
guagagugauuuuugacug

SEQ ID NO: 2413 - RNA, 19 nt, Artificial Sequence
  Synthetic
auuguaucuuuuuguuuug

SEQ ID NO: 2414 - RNA, 19 nt, Artificial Sequence
  Synthetic
uuuaccucacuugaucgau

SEQ ID NO: 2415 - RNA, 19 nt, Artificial Sequence
  Synthetic
aauauaaaaccaugguuuu

SEQ ID NO: 2416 - RNA, 19 nt, Artificial Sequence
  Synthetic
agaguaugauugucuauca

SEQ ID NO: 2417 - RNA, 19 nt, Artificial Sequence
  Synthetic
auaaauuggaauccauuga

SEQ ID NO: 2418 - RNA, 19 nt, Artificial Sequence
  Synthetic
uucaaacaguuacuaaucc

SEQ ID NO: 2419 - RNA, 19 nt, Artificial Sequence
  Synthetic
ccauagaggaauaguugug

SEQ ID NO: 2420 - RNA, 19 nt, Artificial Sequence
  Synthetic
aguuuuaguauacaaucuc

SEQ ID NO: 2421 - RNA, 19 nt, Artificial Sequence
  Synthetic
aaccccucauuguggaaua

SEQ ID NO: 2422 - RNA, 19 nt, Artificial Sequence
  Synthetic
cuauuauaaaaccguuuuc

SEQ ID NO: 2423 - RNA, 19 nt, Artificial Sequence
  Synthetic
aaaaaauauaauucacuca

SEQ ID NO: 2424 - RNA, 19 nt, Artificial Sequence
  Synthetic
ucguugcaauuaacuuuaa

SEQ ID NO: 2425 - RNA, 19 nt, Artificial Sequence
  Synthetic
aauccuuuuauaauucuau

SEQ ID NO: 2426 - RNA, 19 nt, Artificial Sequence
  Synthetic
uuccuuaaaguaggccauc

SEQ ID NO: 2427 - RNA, 19 nt, Artificial Sequence
  Synthetic
guaaguuccaacaaggaag

SEQ ID NO: 2428 - RNA, 19 nt, Artificial Sequence
  Synthetic
aaacguaguccugauaaaa

SEQ ID NO: 2429 - RNA, 19 nt, Artificial Sequence
  Synthetic
ucauuuaugaucauuucaa

SEQ ID NO: 2430 - RNA, 19 nt, Artificial Sequence
  Synthetic
ggaggugauauagccuuau

SEQ ID NO: 2431 - RNA, 19 nt, Artificial Sequence
  Synthetic
aaauaguacucuaauacuc

SEQ ID NO: 2432 - RNA, 19 nt, Artificial Sequence
  Synthetic
uuaggguuguuaagauaac

SEQ ID NO: 2433 - RNA, 19 nt, Artificial Sequence
  Synthetic
gucaaagauaccacaugau

SEQ ID NO: 2434 - RNA, 19 nt, Artificial Sequence
  Synthetic
auuccugguugcauugcaa

SEQ ID NO: 2435 - RNA, 19 nt, Artificial Sequence
  Synthetic
auuugaacuugucugaaca

SEQ ID NO: 2436 - RNA, 19 nt, Artificial Sequence
  Synthetic
aucauuuucucugcuaaua

SEQ ID NO: 2437 - RNA, 19 nt, Artificial Sequence
  Synthetic
aauauuuucuguaguucua

SEQ ID NO: 2438 - RNA, 19 nt, Artificial Sequence
  Synthetic
uuguaauuaucauuguaac

SEQ ID NO: 2439 - RNA, 19 nt, Artificial Sequence
  Synthetic
gauguuucauaucgaaaug

SEQ ID NO: 2440 - RNA, 19 nt, Artificial Sequence
  Synthetic
ccaugcaguucauccagua

SEQ ID NO: 2441 - RNA, 19 nt, Artificial Sequence
  Synthetic
ccuucgauaccacccauau

SEQ ID NO: 2442 - RNA, 19 nt, Artificial Sequence
  Synthetic
acugguuuacuuauaucua

SEQ ID NO: 2443 - RNA, 19 nt, Artificial Sequence
  Synthetic
uacaguaauuuaagacuau

SEQ ID NO: 2444 - RNA, 19 nt, Artificial Sequence
  Synthetic
auaaauugcauaucucuug

SEQ ID NO: 2445 - RNA, 19 nt, Artificial Sequence
  Synthetic
aauagacuuucuccucuau

SEQ ID NO: 2446 - RNA, 19 nt, Artificial Sequence
  Synthetic
aguuguaaagcaauuugau

SEQ ID NO: 2447 - RNA, 19 nt, Artificial Sequence
  Synthetic
augggcaaauucauauaca

SEQ ID NO: 2448 - RNA, 19 nt, Artificial Sequence
  Synthetic
uuuaaaucaugguuuguau

SEQ ID NO: 2449 - RNA, 19 nt, Artificial Sequence
  Synthetic
uuuuugucaaaugugauua

SEQ ID NO: 2450 - RNA, 19 nt, Artificial Sequence
  Synthetic
uuguuuggagcugugcuca

SEQ ID NO: 2451 - RNA, 19 nt, Artificial Sequence
  Synthetic
guagugguauaguguugug

SEQ ID NO: 2452 - RNA, 19 nt, Artificial Sequence
  Synthetic
uuuguaccggauauaagau

SEQ ID NO: 2453 - RNA, 19 nt, Artificial Sequence
  Synthetic
ggaaauauccuuauaagca

SEQ ID NO: 2454 - RNA, 19 nt, Artificial Sequence
  Synthetic
ucucuguuacaaucuaaug

SEQ ID NO: 2455 - RNA, 19 nt, Artificial Sequence
  Synthetic
cucaauauuucccuuuuau

SEQ ID NO: 2456 - RNA, 19 nt, Artificial Sequence
  Synthetic
cuaggugauguaacaccaa

SEQ ID NO: 2457 - RNA, 19 nt, Artificial Sequence
  Synthetic
uuauauuucucuaugauua

SEQ ID NO: 2458 - RNA, 19 nt, Artificial Sequence
  Synthetic
cuaaguucuuccaugaauu

SEQ ID NO: 2459 - RNA, 19 nt, Artificial Sequence
  Synthetic
uuggcuuucucauauguua

SEQ ID NO: 2460 - RNA, 19 nt, Artificial Sequence
  Synthetic
aaauaguuaacacuuaaau

SEQ ID NO: 2461 - RNA, 19 nt, Artificial Sequence
  Synthetic
uaauuuguaguucuauaag

SEQ ID NO: 2462 - RNA, 19 nt, Artificial Sequence
  Synthetic
gggcuaguaucaaagugau

SEQ ID NO: 2463 - RNA, 19 nt, Artificial Sequence
  Synthetic
aauacuauaucaauaucuu

SEQ ID NO: 2464 - RNA, 19 nt, Artificial Sequence
  Synthetic
uuagguauaagaauaauuc

SEQ ID NO: 2465 - RNA, 19 nt, Artificial Sequence
  Synthetic
aauaugggagguuucauua

SEQ ID NO: 2466 - RNA, 19 nt, Artificial Sequence
  Synthetic
uuaugcgccaauauuaaau

SEQ ID NO: 2467 - RNA, 19 nt, Artificial Sequence
  Synthetic
ugaaaauagucagauaucu

SEQ ID NO: 2468 - RNA, 19 nt, Artificial Sequence
  Synthetic
ucuuuuucaaaaauacccu

SEQ ID NO: 2469 - RNA, 19 nt, Artificial Sequence
  Synthetic
uuugcucugccguaaccuu

SEQ ID NO: 2470 - RNA, 19 nt, Artificial Sequence
  Synthetic
cauaggagaucugaaguau

SEQ ID NO: 2471 - RNA, 19 nt, Artificial Sequence
  Synthetic
uccuggcuaagaauguauu

SEQ ID NO: 2472 - RNA, 19 nt, Artificial Sequence
  Synthetic
uuaagaaaccauaguuuga

SEQ ID NO: 2473 - RNA, 19 nt, Artificial Sequence
  Synthetic
uuaucuauauuuaucaauc

SEQ ID NO: 2474 - RNA, 19 nt, Artificial Sequence
  Synthetic
uuauuuuuaauguauauuu

SEQ ID NO: 2475 - RNA, 19 nt, Artificial Sequence
  Synthetic
uuuucuaggguuucuggug

SEQ ID NO: 2476 - RNA, 19 nt, Artificial Sequence
  Synthetic
accggauugguuaguauau

SEQ ID NO: 2477 - RNA, 19 nt, Artificial Sequence
  Synthetic
uuuuugucauuacauuuaa

SEQ ID NO: 2478 - RNA, 19 nt, Artificial Sequence
  Synthetic
acaaccguaggaaauaaau

SEQ ID NO: 2479 - RNA, 19 nt, Artificial Sequence
  Synthetic
ucuauaauuuuaucaauca

SEQ ID NO: 2480 - RNA, 19 nt, Artificial Sequence
  Synthetic
uaaaguugguuagauuugg

SEQ ID NO: 2481 - RNA, 19 nt, Artificial Sequence
  Synthetic
ugaugagaaguaguagugu

SEQ ID NO: 2482 - RNA, 19 nt, Artificial Sequence
  Synthetic
uugugcacuaaagguauuu

SEQ ID NO: 2483 - RNA, 19 nt, Artificial Sequence
  Synthetic
acuguuacaggcaauucag

SEQ ID NO: 2484 - RNA, 19 nt, Artificial Sequence
  Synthetic
ugcuugcuccacucuauua

SEQ ID NO: 2485 - RNA, 19 nt, Artificial Sequence
  Synthetic
ucuaauuugaaaucgauau

SEQ ID NO: 2486 - RNA, 19 nt, Artificial Sequence
  Synthetic
gaccccuuuaacuuacugc

SEQ ID NO: 2487 - RNA, 19 nt, Artificial Sequence
  Synthetic
uuaaauacugggaacacau

SEQ ID NO: 2488 - RNA, 19 nt, Artificial Sequence
  Synthetic
ucuuuaucagccuucuuag

SEQ ID NO: 2489 - RNA, 19 nt, Artificial Sequence
  Synthetic
acuucauuacguccugcua

SEQ ID NO: 2490 - RNA, 19 nt, Artificial Sequence
  Synthetic
accauauauaaaugauuau

SEQ ID NO: 2491 - RNA, 19 nt, Artificial Sequence
  Synthetic
uuuaacaauucacuuagau

SEQ ID NO: 2492 - RNA, 19 nt, Artificial Sequence
  Synthetic
aacaaacuaccugugauuu

SEQ ID NO: 2493 - RNA, 19 nt, Artificial Sequence
  Synthetic
aagauuuuuauucauuauu

SEQ ID NO: 2494 - RNA, 19 nt, Artificial Sequence
  Synthetic
uaugggaauuuuuaauaua

SEQ ID NO: 2495 - RNA, 19 nt, Artificial Sequence
  Synthetic
acaguguuaguguguagcu

SEQ ID NO: 2496 - RNA, 19 nt, Artificial Sequence
  Synthetic
uaaaaguuauuaaaaaauu

SEQ ID NO: 2497 - RNA, 19 nt, Artificial Sequence
  Synthetic
auuuuaggauuaguucacu

SEQ ID NO: 2498 - RNA, 19 nt, Artificial Sequence
  Synthetic
uggauuuaaauuuauuccu

SEQ ID NO: 2499 - RNA, 19 nt, Artificial Sequence
  Synthetic
auauaaaccaauuagauuu

SEQ ID NO: 2500 - RNA, 19 nt, Artificial Sequence
  Synthetic
guaguuuaguuaauauaca

SEQ ID NO: 2501 - RNA, 19 nt, Artificial Sequence
  Synthetic
augcauuaguuaaauguau

SEQ ID NO: 2502 - RNA, 19 nt, Artificial Sequence
  Synthetic
caugcacaaauacaaugcc

SEQ ID NO: 2503 - RNA, 19 nt, Artificial Sequence
  Synthetic
aauuggauuucacuacaau

SEQ ID NO: 2504 - RNA, 19 nt, Artificial Sequence
  Synthetic
acacuggcauuguugugaa

SEQ ID NO: 2505 - RNA, 19 nt, Artificial Sequence
  Synthetic
uauaaccuccauuuuguaa

SEQ ID NO: 2506 - RNA, 19 nt, Artificial Sequence
  Synthetic
guugagagcaguguguuaa

SEQ ID NO: 2507 - RNA, 19 nt, Artificial Sequence
  Synthetic
caucuauuaggccauuagg

SEQ ID NO: 2508 - RNA, 19 nt, Artificial Sequence
  Synthetic
cuuucccauuaauaucuug

SEQ ID NO: 2509 - RNA, 19 nt, Artificial Sequence
  Synthetic
uuuuauuugccccauuuuu

SEQ ID NO: 2510 - RNA, 19 nt, Artificial Sequence
  Synthetic
gcaaacuuuuccaugaugu

SEQ ID NO: 2511 - RNA, 19 nt, Artificial Sequence
  Synthetic
ucuaucaugucuucucuua

SEQ ID NO: 2512 - RNA, 19 nt, Artificial Sequence
  Synthetic
aaugaagguccauugggug

SEQ ID NO: 2513 - RNA, 19 nt, Artificial Sequence
  Synthetic
ugauuuugccuggcguguu

SEQ ID NO: 2514 - RNA, 19 nt, Artificial Sequence
  Synthetic
uauucacagaguuuguuca

SEQ ID NO: 2515 - RNA, 19 nt, Artificial Sequence
  Synthetic
uuucuagugucuugguggu

SEQ ID NO: 2516 - RNA, 19 nt, Artificial Sequence
  Synthetic
acugcauguuguuugauaa

SEQ ID NO: 2517 - RNA, 19 nt, Artificial Sequence
  Synthetic
agcgucuguuccauuacac

SEQ ID NO: 2518 - RNA, 19 nt, Artificial Sequence
  Synthetic
agcacuuuugauuuuguuc

SEQ ID NO: 2519 - RNA, 19 nt, Artificial Sequence
  Synthetic
aggggaugugugcaguuuc

SEQ ID NO: 2520 - RNA, 19 nt, Artificial Sequence
  Synthetic
uacagacacagugucaacc

SEQ ID NO: 2521 - RNA, 19 nt, Artificial Sequence
  Synthetic
aguaucgaugcuuuuaucc

SEQ ID NO: 2522 - RNA, 19 nt, Artificial Sequence
  Synthetic
uccacuuauuucugauaaa

SEQ ID NO: 2523 - RNA, 19 nt, Artificial Sequence
  Synthetic
ccuuuaugauacuuagaca

SEQ ID NO: 2524 - RNA, 19 nt, Artificial Sequence
  Synthetic
auauuuuuccaugucaaga

SEQ ID NO: 2525 - RNA, 19 nt, Artificial Sequence
  Synthetic
aaaaauagagauuguacac

SEQ ID NO: 2526 - RNA, 19 nt, Artificial Sequence
  Synthetic
auagcuaaauguaaccaga

SEQ ID NO: 2527 - RNA, 19 nt, Artificial Sequence
  Synthetic
aaaaccucaguaacugcca

SEQ ID NO: 2528 - RNA, 19 nt, Artificial Sequence
  Synthetic
aacccaagaauuccuaugc

SEQ ID NO: 2529 - RNA, 19 nt, Artificial Sequence
  Synthetic
auuguaggcgauuuaauaa

SEQ ID NO: 2530 - RNA, 19 nt, Artificial Sequence
  Synthetic
uuaggaucuuuaauuauaa

SEQ ID NO: 2531 - RNA, 19 nt, Artificial Sequence
  Synthetic
auaucgggaugaaguucca

SEQ ID NO: 2532 - RNA, 19 nt, Artificial Sequence
  Synthetic
ucauugcaauccuucagac

SEQ ID NO: 2533 - RNA, 19 nt, Artificial Sequence
  Synthetic
aaauaacuauaauugaaua

SEQ ID NO: 2534 - RNA, 19 nt, Artificial Sequence
  Synthetic
uauauaauuuuuaauuuua

SEQ ID NO: 2535 - RNA, 23 nt, Artificial Sequence
  Synthetic
aacuugcguaaaccaaaaaaaug

SEQ ID NO: 2536 - RNA, 23 nt, Artificial Sequence
  Synthetic
uggggcaaauaagaauuugauaa

SEQ ID NO: 2537 - RNA, 23 nt, Artificial Sequence
  Synthetic
uucuccaaaaaacuaagugauuc

SEQ ID NO: 2538 - RNA, 23 nt, Artificial Sequence
  Synthetic
cuggucaacuaugaaaugaaacu

SEQ ID NO: 2539 - RNA, 23 nt, Artificial Sequence
  Synthetic
gggaagcacuaaauacaaaaaau

SEQ ID NO: 2540 - RNA, 23 nt, Artificial Sequence
  Synthetic
cacucccauaauauacaaguaug

SEQ ID NO: 2541 - RNA, 23 nt, Artificial Sequence
  Synthetic
gucauccagcaaauacaccaucc

SEQ ID NO: 2542 - RNA, 23 nt, Artificial Sequence
  Synthetic
aacagcuucuaugaaguguuuga

SEQ ID NO: 2543-2638 - skipped (96 entries)

SEQ ID NO: 2639 - DNA, 21 bp, Artificial Sequence
  Synthetic
  misc_feature (1)..(19): ribonucleotide modified as described
cuugcguaaaccaaaaaaatt

SEQ ID NO: 2640 - DNA, 21 bp, Artificial Sequence
  Synthetic
  misc_feature (1)..(19): ribonucleotide modified as described
gggcaaauaagaauuugautt

SEQ ID NO: 2641 - DNA, 21 bp, Artificial Sequence
  Synthetic
  misc_feature (1)..(19): ribonucleotide modified as described
cuccaaaaaacuaagugautt

SEQ ID NO: 2642 - DNA, 21 bp, Artificial Sequence
  Synthetic
  misc_feature (1)..(19): ribonucleotide modified as described
ggucaacuaugaaaugaaatt

SEQ ID NO: 2643 - DNA, 21 bp, Artificial Sequence
  Synthetic
  misc_feature (1)..(19): ribonucleotide modified as described
gaagcacuaaauacaaaaatt

SEQ ID NO: 2644 - DNA, 21 bp, Artificial Sequence
  Synthetic
  misc_feature (1)..(19): ribonucleotide modified as described
cucccauaauauacaaguatt

SEQ ID NO: 2645 - DNA, 21 bp, Artificial Sequence
  Synthetic
  misc_feature (1)..(19): ribonucleotide modified as described
cauccagcaaauacaccautt

SEQ ID NO: 2646 - DNA, 21 bp, Artificial Sequence
  Synthetic
  misc_feature (1)..(19): ribonucleotide modified as described
cagcuucuaugaaguguuutt

SEQ ID NO: 2647 - DNA, 21 bp, Artificial Sequence
  Synthetic
  misc_feature (1)..(19): ribonucleotide modified as described
uuuuuuugguuuacgcaagtt

SEQ ID NO: 2648 - DNA, 21 bp, Artificial Sequence
  Synthetic
  misc_feature (1)..(19): ribonucleotide modified as described
  misc_feature (1)..(19)
aucaaauucuuauuugccctt

SEQ ID NO: 2649 - DNA, 21 bp, Artificial Sequence
  Synthetic
  misc_feature (1)..(19): ribonucleotide modified as described
aucacuuaguuuuuuggagtt

SEQ ID NO: 2650 - DNA, 21 bp, Artificial Sequence
  Synthetic
  misc_feature (1)..(19): ribonucleotide modified as described
uuucauuucauaguugacctt

SEQ ID NO: 2651 - DNA, 21 bp, Artificial Sequence
  Synthetic
  misc_feature (1)..(19): ribonucleotide modified as described
uuuuuguauuuagugcuuctt

SEQ ID NO: 2652 - DNA, 21 bp, Artificial Sequence
  Synthetic
  misc_feature (1)..(19): ribonucleotide modified as described
uacuuguauauuaugggagtt

SEQ ID NO: 2653 - DNA, 21 bp, Artificial Sequence
  Synthetic
  misc_feature (1)..(19): ribonucleotide modified as described
augguguauuugcuggaugtt

SEQ ID NO: 2654 - DNA, 21 bp, Artificial Sequence
  Synthetic
  misc_feature (1)..(19): ribonucleotide modified as described
aaacacuucauagaagcugtt

SEQ ID NO: 2655 - DNA, 21 bp, Artificial Sequence
  Synthetic
  misc_feature (1)..(19): ribonucleotide modified as described
  misc_feature (1)..(1): 5'-3 attached inverted abasic moiety
  misc_feature (1)..(3): 2'-deoxy-2'-fluoro
  misc_feature (5)..(5): 2'-deoxy-2'-fluoro
  misc_feature (7)..(7): 2'-deoxy-2'-fluoro
  misc_feature (11)..(12): 2'-deoxy-2'-fluoro
  misc_feature (21)..(21): 3'-3 attached inverted abasic moiety
cuugcguaaaccaaaaaaatt

SEQ ID NO: 2656 - DNA, 21 bp, Artificial Sequence
  Synthetic
  misc_feature (1)..(19): ribonucleotide modified as described
  misc_feature (1)..(1): 5'-3 attached deoxy abasic moiety
  misc_feature (4)..(4): 2'-deoxy-2'-fluoro
  misc_feature (8)..(8): 2'-deoxy-2'-fluoro
  misc_feature (14)..(16): 2'-deoxy-2'-fluoro
  misc_feature (19)..(19): 2'-deoxy-2'-fluoro
  misc_feature (21)..(21): 3'-3 attached deoxy abasic moiety
gggcaaauaagaauuugautt

SEQ ID NO: 2657 - DNA, 21 bp, Artificial Sequence
  Synthetic
  misc_feature (1)..(19): ribonucleotide modified as described
  misc_feature (1)..(1): 5'-3 attached deoxy abasic moiety
  misc_feature (1)..(4): 2'-deoxy-2'-fluoro
  misc_feature (11)..(12): 2'-deoxy-2'-fluoro
  misc_feature (16)..(16): 2'-deoxy-2'-fluoro
  misc_feature (19)..(19): 2'-deoxy-2'-fluoro
  misc_feature (21)..(21): 3'-3 attached deoxy abasic moiety
cuccaaaaaacuaagugautt

SEQ ID NO: 2658 - DNA, 21 bp, Artificial Sequence
  Synthetic
  misc_feature (1)..(19): ribonucleotide modified as described
  misc_feature (1)..(1): 5'-3 attached deoxy abasic moiety
  misc_feature (3)..(4): 2'-deoxy-2'-fluoro
  misc_feature (7)..(8): 2'-deoxy-2'-fluoro
  misc_feature (10)..(10): 2'-deoxy-2'-fluoro
  misc_feature (15)..(15): 2'-deoxy-2'-fluoro
  misc_feature (21)..(21): 3'-3 attached deoxy abasic moiety
ggucaacuaugaaaugaaatt

SEQ ID NO: 2659 - DNA, 21 bp, Artificial Sequence
  Synthetic
  misc_feature (1)..(19): ribonucleotide modified as described
  misc_feature (1)..(1): 5'-3 attached deoxy abasic moiety
  misc_feature (5)..(5): 2'-deoxy-2'-fluoro
  misc_feature (7)..(8): 2'-deoxy-2'-fluoro
  misc_feature (12)..(12): 2'-deoxy-2'-fluoro
  misc_feature (14)..(14): 2'-deoxy-2'-fluoro
  misc_feature (21)..(21): 3'-3 attached deoxy abasic moiety
gaagcacuaaauacaaaaatt

SEQ ID NO: 2660 - DNA, 21 bp, Artificial Sequence
  Synthetic
  misc_feature (1)..(19): ribonucleotide modified as described
  misc_feature (1)..(1): 5'-3 attached deoxy abasic moiety
  misc_feature (1)..(5): 2'-deoxy-2'-fluoro
  misc_feature (7)..(7): 2'-deoxy-2'-fluoro
  misc_feature (10)..(10): 2'-deoxy-2'-fluoro
  misc_feature (12)..(12): 2'-deoxy-2'-fluoro
  misc_feature (14)..(14): 2'-deoxy-2'-fluoro
  misc_feature (18)..(18): 2'-deoxy-2'-fluoro
  misc_feature (21)..(21): 3'-3 attached deoxy abasic moiety
cucccauaauauacaaguatt

SEQ ID NO: 2661 - DNA, 21 bp, Artificial Sequence
  Synthetic
  misc_feature (1)..(19): ribonucleotide modified as described
  misc_feature (1)..(1): 5'-3 inverted deoxy abasic moiety
  misc_feature (1)..(1): 2'-deoxy-2'-fluoro
  misc_feature (3)..(5): 2'-deoxy-2'-fluoro
  misc_feature (8)..(8): 2'-deoxy-2'-fluoro
  misc_feature (12)..(12): 2'-deoxy-2'-fluoro
  misc_feature (14)..(14): 2'-deoxy-2'-fluoro
  misc_feature (16)..(17): 2'-deoxy-2'-fluoro
  misc_feature (19)..(19): 2'-deoxy-2'-fluoro
  misc_feature (21)..(21): 3'-3 inverted deoxy abasic moiety
cauccagcaaauacaccautt

SEQ ID NO: 2662 - DNA, 21 bp, Artificial Sequence
  Synthetic
  misc_feature (1)..(19): ribonucleotide modified as described
  misc_feature (1)..(1): 5'-3 attached inverted abasic moiety
  misc_feature (1)..(1): 2'-deoxy-2'-fluoro
  misc_feature (4)..(8): 2'-deoxy-2'-fluoro
  misc_feature (10)..(10): 2'-deoxy-2'-fluoro
  misc_feature (15)..(15): 2'-deoxy-2'-fluoro
  misc_feature (17)..(19): 2'-deoxy-2'-fluoro
  misc_feature (21)..(21): 3'-3 attached inverted abasic moiety
cagcuucuaugaaguguuutt

SEQ ID NO: 2663 - DNA, 21 bp, Artificial Sequence
  Synthetic
  misc_feature (1)..(19): ribonucleotide modified as described
  misc_feature (1)..(7): 2'-deoxy-2'-fluoro
  misc_feature (10)..(12): 2'-deoxy-2'-fluoro
  misc_feature (14)..(14): 2'-deoxy-2'-fluoro
  misc_feature (16)..(16): 2'-deoxy-2'-fluoro
  misc_feature (20)..(21): phosphorothioate linkage
uuuuuuugguuuacgcaagtt

SEQ ID NO: 2664 - DNA, 21 bp, Artificial Sequence
  Synthetic
  misc_feature (1)..(19): ribonucleotide modified as described
  misc_feature (2)..(3): 2'-deoxy-2'-fluoro
  misc_feature (7)..(11): 2'-deoxy-2'-fluoro
  misc_feature (13)..(15): 2'-deoxy-2'-fluoro
  misc_feature (17)..(19): 2'-deoxy-2'-fluoro
  misc_feature (20)..(21): phosphorothioate linkage
aucaaauucuuauuugccctt

SEQ ID NO: 2665 - DNA, 21 bp, Artificial Sequence
  Synthetic
  misc_feature (1)..(19): ribonucleotide modified as described
  misc_feature (2)..(3): 2'-deoxy-2'-fluoro
  misc_feature (5)..(7): 2'-deoxy-2'-fluoro
  misc_feature (10)..(15): 2'-deoxy-2'-fluoro
  misc_feature (20)..(21): phosphorothioate linkage
aucacuuaguuuuuuggagtt

SEQ ID NO: 2666 - DNA, 21 bp, Artificial Sequence
  Synthetic
  misc_feature (1)..(19): ribonucleotide modified as described
  misc_feature (1)..(4): 2'-deoxy-2'-fluoro
  misc_feature (6)..(8): 2'-deoxy-2'-fluoro
  misc_feature (11)..(11): 2'-deoxy-2'-fluoro
  misc_feature (14)..(15): 2'-deoxy-2'-fluoro
  misc_feature (18)..(19): 2'-deoxy-2'-fluoro
  misc_feature (20)..(21): phosphorothioate linkage
uuucauuucauaguugacctt

SEQ ID NO: 2667 - DNA, 21 bp, Artificial Sequence
  Synthetic
  misc_feature (1)..(19): ribonucleotide modified as described
  misc_feature (1)..(5): 2'-deoxy-2'-fluoro
  misc_feature (7)..(7): 2'-deoxy-2'-fluoro
  misc_feature (9)..(11): 2'-deoxy-2'-fluoro
  misc_feature (14)..(14): 2'-deoxy-2'-fluoro
  misc_feature (16)..(19): 2'-deoxy-2'-fluoro
  misc_feature (20)..(21): phosphorothioate linkage
uuuuuguauuuagugcuuctt

SEQ ID NO: 2668 - DNA, 21 bp, Artificial Sequence
  Synthetic
  misc_feature (1)..(19): ribonucleotide modified as described
  misc_feature (1)..(1): 2'-deoxy-2'-fluoro
  misc_feature (3)..(5): 2'-deoxy-2'-fluoro
  misc_feature (7)..(7): 2'-deoxy-2'-fluoro
  misc_feature (9)..(9): 2'-deoxy-2'-fluoro
  misc_feature (11)..(12): 2'-deoxy-2'-fluoro
  misc_feature (14)..(14): 2'-deoxy-2'-fluoro
  misc_feature (20)..(21): phosphorothioate linkage
uacuuguauauuaugggagtt

SEQ ID NO: 2669 - DNA, 21 bp, Artificial Sequence
  Synthetic
  misc_feature (1)..(19): ribonucleotide modified as described
  misc_feature (2)..(2): 2'-deoxy-2'-fluoro
  misc_feature (5)..(5): 2'-deoxy-2'-fluoro
  misc_feature (7)..(7): 2'-deoxy-2'-fluoro
  misc_feature (9)..(11): 2'-deoxy-2'-fluoro
  misc_feature (13)..(14): 2'-deoxy-2'-fluoro
  misc_feature (18)..(18): 2'-deoxy-2'-fluoro
  misc_feature (20)..(21): phosphorothioate linkage
augguguauuugcuggaugtt

SEQ ID NO: 2670 - DNA, 21 bp, Artificial Sequence
  Synthetic
  misc_feature (1)..(19): ribonucleotide modified as described
  misc_feature (4)..(4): 2'-deoxy-2'-fluoro
  misc_feature (6)..(9): 2'-deoxy-2'-fluoro
  misc_feature (11)..(11): 2'-deoxy-2'-fluoro
  misc_feature (17)..(18): 2'-deoxy-2'-fluoro
  misc_feature (20)..(21): phosphorothioate linkage
aaacacuucauagaagcugtt

SEQ ID NO: 2671 - DNA, 21 bp, Artificial Sequence
  Synthetic
  misc_feature (1)..(19): ribonucleotide modified as described
  misc_feature (1)..(1): 5'-3 attached inverted deoxy abasic moiety
  misc_feature (1)..(3): 2'-deoxy-2'-fluoro
  misc_feature (4)..(4): 2'-deoxy
  misc_feature (5)..(5): 2'-deoxy-2'-fluoro
  misc_feature (6)..(6): 2'-deoxy
  misc_feature (7)..(7): 2'-deoxy-2'-fluoro
  misc_feature (7)..(10): 2'-deoxy
  misc_feature (11)..(12): 2'-deoxy-2'-fluoro
  misc_feature (13)..(19): 2'-deoxy
  misc_feature (21)..(21): 3'-3 attached inverted deoxy abasic moiety
cuugcguaaaccaaaaaaatt

SEQ ID NO: 2672 - DNA, 21 bp, Artificial Sequence
  Synthetic
  misc_feature (1)..(19): ribonucleotide modified as described
  misc_feature (1)..(1): 5'-3 attached inverted deoxy abasic moiety
  misc_feature (1)..(3): 2'-deoxy
  misc_feature (4)..(4): 2'-deoxy-2'-fluoro
  misc_feature (5)..(7): 2'-deoxy
  misc_feature (8)..(8): 2'-deoxy-2'-fluoro
  misc_feature (9)..(13): 2'-deoxy
  misc_feature (14)..(16): 2'-deoxy-2'-fluoro
  misc_feature (17)..(18): 2'-deoxy
  misc_feature (19)..(19): 2'-deoxy-2'-fluoro
  misc_feature (21)..(21): 3'-3 attached inverted deoxy abasic moiety
gggcaaauaagaauuugautt

SEQ ID NO: 2673 - DNA, 21 bp, Artificial Sequence
  Synthetic
  misc_feature (1)..(19): ribonucleotide modified as described
  misc_feature (1)..(1): 5'-3 attached inverted deoxy abasic moiety
  misc_feature (1)..(4): 2'-deoxy-2'-fluoro
  misc_feature (5)..(10): 2'-deoxy
  misc_feature (11)..(12): 2'-deoxy-2'-fluoro
  misc_feature (13)..(15): 2'-deoxy
  misc_feature (16)..(16): 2'-deoxy-2'-fluoro
  misc_feature (17)..(18): 2'-deoxy
  misc_feature (19)..(19): 2'-deoxy-2'-fluoro
  misc_feature (21)..(21): 3'-3 attached inverted deoxy abasic moiety
cuccaaaaaacuaagugautt

SEQ ID NO: 2674 - DNA, 21 bp, Artificial Sequence
  Synthetic
  misc_feature (1)..(19): ribonucleotide modified as described
  misc_feature (1)..(1): 5'-3 attached inverted deoxy abasic moiety
  misc_feature (1)..(2): 2'-deoxy
  misc_feature (3)..(4): 2'-deoxy-2'-fluoro
  misc_feature (5)..(6): 2'-deoxy
  misc_feature (7)..(8): 2'-deoxy-2'-fluoro
  misc_feature (9)..(9): 2'-deoxy
  misc_feature (10)..(10): 2'-deoxy-2'-fluoro
  misc_feature (11)..(14): 2'-deoxy
  misc_feature (15)..(15): 2'-deoxy-2'-fluoro
  misc_feature (16)..(19): 2'-deoxy
  misc_feature (21)..(21): 3'-3 attached inverted deoxy abasic moiety
ggucaacuaugaaaugaaatt

SEQ ID NO: 2675 - DNA, 21 bp, Artificial Sequence
  Synthetic
  misc_feature (1)..(19): ribonucleotide modified as described
  misc_feature (1)..(1): 5'-3 attached inverted deoxy abasic moiety
  misc_feature (1)..(4): 2'-deoxy
  misc_feature (5)..(5): 2'-deoxy-2'-fluoro
  misc_feature (6)..(6): 2'-deoxy
  misc_feature (7)..(8): 2'-deoxy-2'-fluoro
  misc_feature (9)..(11): 2'-deoxy
  misc_feature (12)..(12): 2'-deoxy-2'-fluoro
  misc_feature (13)..(13): 2'-deoxy
  misc_feature (14)..(14): 2'-deoxy-2'-fluoro
  misc_feature (15)..(19): 2'-deoxy
  misc_feature (21)..(21): 3'-3 attached inverted deoxy abasic moiety
gaagcacuaaauacaaaaatt

SEQ ID NO: 2676 - DNA, 21 bp, Artificial Sequence
  Synthetic
  misc_feature (1)..(19): ribonucleotide modified as described
  misc_feature (1)..(1): 5'-3 attached inverted deoxy abasic moiety
  misc_feature (1)..(5): 2'-deoxy-2'-fluoro
  misc_feature (6)..(6): 2'-deoxy
  misc_feature (7)..(7): 2'-deoxy-2'-fluoro
  misc_feature (8)..(9): 2'-deoxy
  misc_feature (10)..(10): 2'-deoxy-2'-fluoro
  misc_feature (11)..(11): 2'-deoxy
  misc_feature (12)..(12): 2'-deoxy-2'-fluoro
  misc_feature (13)..(13): 2'-deoxy
  misc_feature (14)..(14): 2'-deoxy-2'-fluoro
  misc_feature (15)..(17): 2'-deoxy
  misc_feature (18)..(18): 2'-deoxy-2'-fluoro
  misc_feature (19)..(19): 2'-deoxy
  misc_feature (21)..(21): 3'-3 attached inverted deoxy abasic moiety
cucccauaauauacaaguatt

SEQ ID NO: 2677 - DNA, 21 bp, Artificial Sequence
  Synthetic
  misc_feature (1)..(19): ribonucleotide modified as described
  misc_feature (1)..(1): 5'-3 attached inverted deoxy abasic moiety
  misc_feature (1)..(1): 2'-deoxy-2'-fluoro
  misc_feature (2)..(2): 2'-deoxy
  misc_feature (3)..(5): 2'-deoxy-2'-fluoro
  misc_feature (6)..(7): 2'-deoxy
  misc_feature (8)..(8): 2'-deoxy-2'-fluoro
  misc_feature (9)..(11): 2'-deoxy
  misc_feature (12)..(12): 2'-deoxy-2'-fluoro
  misc_feature (13)..(13): 2'-deoxy
  misc_feature (14)..(14): 2'-deoxy-2'-fluoro
  misc_feature (15)..(15): 2'-deoxy
  misc_feature (16)..(17): 2'-deoxy-2'-fluoro
  misc_feature (18)..(18): 2'-deoxy
  misc_feature (19)..(19): 2'-deoxy-2'-fluoro
  misc_feature (21)..(21): 3'-3 attached inverted deoxy abasic moiety
cauccagcaaauacaccautt

SEQ ID NO: 2678 - DNA, 21 bp, Artificial Sequence
  Synthetic
  misc_feature (1)..(19): ribonucleotide modified as described
  misc_feature (1)..(1): 5'-3 attached inverted deoxy abasic moiety
  misc_feature (1)..(1): 2'-deoxy-2'-fluoro
  misc_feature (2)..(3): 2'-deoxy
  misc_feature (4)..(8): 2'-deoxy-2'-fluoro
  misc_feature (9)..(9): 2'-deoxy
  misc_feature (10)..(10): 2'-deoxy-2'-fluoro
  misc_feature (11)..(14): 2'-deoxy
  misc_feature (15)..(15): 2'-deoxy-2'-fluoro
  misc_feature (16)..(16): 2'-deoxy
  misc_feature (17)..(19): 2'-deoxy-2'-fluoro
  misc_feature (21)..(21): 3'-3 attached inverted deoxy abasic moiety
cagcuucuaugaaguguuutt

SEQ ID NO: 2679 - DNA, 21 bp, Artificial Sequence
  Synthetic
  misc_feature (1)..(19): ribonucleotide modified as described
  misc_feature (1)..(7): 2'-deoxy-2'-fluoro
  misc_feature (8)..(9): 2'-deoxy
  misc_feature (10)..(12): 2'-deoxy-2'-fluoro
  misc_feature (13)..(13): 2'-deoxy
  misc_feature (14)..(14): 2'-deoxy-2'-fluoro
  misc_feature (15)..(15): 2'-deoxy
  misc_feature (16)..(16): 2'-deoxy-2'-fluoro
  misc_feature (17)..(19): 2'-deoxy
  misc_feature (20)..(21): phosphorothioate linkage
uuuuuuugguuuacgcaagtt

SEQ ID NO: 2680 - DNA, 21 bp, Artificial Sequence
  Synthetic
  misc_feature (1)..(19): ribonucleotide modified as described
  misc_feature (1)..(1): 2'-deoxy
  misc_feature (2)..(3): 2'-deoxy-2'-fluoro
  misc_feature (4)..(6): 2'-deoxy
  misc_feature (7)..(11): 2'-deoxy-2'-fluoro
  misc_feature (12)..(12): 2'-deoxy
  misc_feature (13)..(15): 2'-deoxy-2'-fluoro
  misc_feature (16)..(16): 2'-deoxy
  misc_feature (17)..(19): 2'-deoxy-2'-fluoro
  misc_feature (20)..(21): phosphorothioate linkage
aucaaauucuuauuugccctt

SEQ ID NO: 2681 - DNA, 21 bp, Artificial Sequence
  Synthetic
  misc_feature (1)..(19): ribonucleotide modified as described
  misc_feature (1)..(1): 2'-deoxy
  misc_feature (2)..(3): 2'-deoxy-2'-fluoro
  misc_feature (4)..(4): 2'-deoxy
  misc_feature (5)..(7): 2'-deoxy-2'-fluoro
  misc_feature (8)..(9): 2'-deoxy
  misc_feature (10)..(15): 2'-deoxy-2'-fluoro
  misc_feature (16)..(19): 2'-deoxy
  misc_feature (20)..(21): phosphorothioate linkage
aucacuuaguuuuuuggagtt

SEQ ID NO: 2682 - DNA, 21 bp, Artificial Sequence
  Synthetic
  misc_feature (1)..(19): ribonucleotide modified as described
  misc_feature (1)..(4): 2'-deoxy-2'-fluoro
  misc_feature (5)..(5): 2'-deoxy
  misc_feature (6)..(9): 2'-deoxy-2'-fluoro
  misc_feature (10)..(10): 2'-deoxy
  misc_feature (11)..(11): 2'-deoxy-2'-fluoro
  misc_feature (12)..(13): 2'-deoxy
  misc_feature (14)..(15): 2'-deoxy-2'-fluoro
  misc_feature (16)..(17): 2'-deoxy
  misc_feature (18)..(19): 2'-deoxy-2'-fluoro
  misc_feature (20)..(21): phosphorothioate linkage
uuucauuucauaguugacctt

SEQ ID NO: 2683 - DNA, 21 bp, Artificial Sequence
  Synthetic
  misc_feature (1)..(19): ribonucleotide modified as described
  misc_feature (1)..(5): 2'-deoxy-2'-fluoro
  misc_feature (6)..(6): 2'-deoxy
  misc_feature (7)..(7): 2'-deoxy-2'-fluoro
  misc_feature (8)..(8): 2'-deoxy
  misc_feature (9)..(11): 2'-deoxy-2'-fluoro
  misc_feature (12)..(13): 2'-deoxy
  misc_feature (14)..(14): 2'-deoxy-2'-fluoro
  misc_feature (15)..(15): 2'-deoxy
  misc_feature (16)..(19): 2'-deoxy-2'-fluoro
  misc_feature (20)..(21): phosphorothioate linkage
uuuuuguauuuagugcuuctt

SEQ ID NO: 2684 - DNA, 21 bp, Artificial Sequence
  Synthetic
  misc_feature (1)..(19): ribonucleotide modified as described
  misc_feature (1)..(1): 2'-deoxy-2'-fluoro
  misc_feature (2)..(2): 2'-deoxy
  misc_feature (3)..(5): 2'-deoxy-2'-fluoro
  misc_feature (6)..(6): 2'-deoxy
  misc_feature (7)..(7): 2'-deoxy-2'-fluoro
  misc_feature (8)..(8): 2'-deoxy
  misc_feature (9)..(9): 2'-deoxy-2'-fluoro
  misc_feature (10)..(10): 2'-deoxy
  misc_feature (11)..(12): 2'-deoxy-2'-fluoro
  misc_feature (13)..(13): 2'-deoxy
  misc_feature (14)..(14): 2'-deoxy-2'-fluoro
  misc_feature (15)..(19): 2'-deoxy
  misc_feature (20)..(21): phosphorothioate linkage
uacuuguauauuaugggagtt

SEQ ID NO: 2685 - DNA, 21 bp, Artificial Sequence
  Synthetic
  misc_feature (1)..(19): ribonucleotide modified as described
  misc_feature (1)..(1): 2'-deoxy
  misc_feature (2)..(2): 2'-deoxy-2'-fluoro
  misc_feature (3)..(4): 2'-deoxy
  misc_feature (5)..(5): 2'-deoxy-2'-fluoro
  misc_feature (6)..(6): 2'-deoxy
  misc_feature (7)..(7): 2'-deoxy-2'-fluoro
  misc_feature (8)..(8): 2'-deoxy
  misc_feature (9)..(11): 2'-deoxy-2'-fluoro
  misc_feature (12)..(12): 2'-deoxy
  misc_feature (13)..(14): 2'-deoxy-2'-fluoro
  misc_feature (15)..(17): 2'-deoxy
  misc_feature (18)..(18): 2'-deoxy-2'-fluoro
  misc_feature (19)..(19): 2'-deoxy
  misc_feature (20)..(21): phosphorothioate linkage
augguguauuugcuggaugtt

SEQ ID NO: 2686 - DNA, 21 bp, Artificial Sequence
  Synthetic
  misc_feature (1)..(19): ribonucleotide modified as described
  misc_feature (1)..(3): 2'-deoxy
  misc_feature (4)..(4): 2'-deoxy-2'-fluoro
  misc_feature (5)..(5): 2'-deoxy
  misc_feature (6)..(9): 2'-deoxy-2'-fluoro
  misc_feature (10)..(10): 2'-deoxy
  misc_feature (11)..(11): 2'-deoxy-2'-fluoro
  misc_feature (12)..(16): 2'-deoxy
  misc_feature (17)..(18): 2'-deoxy-2'-fluoro
  misc_feature (19)..(19): 2'-deoxy
  misc_feature (20)..(21): phosphorothioate linkage
aaacacuucauagaagcugtt

SEQ ID NO: 2687 - DNA, 21 bp, Artificial Sequence
  Synthetic
  misc_feature (1)..(19): ribonucleotide modified as described
  misc_feature (1)..(1): 5'-3 attached inverted deoxy abasic
  misc_feature (1)..(3): 2'-deoxy-2'-fluoro
  misc_feature (4)..(4): 2'-O-methyl
  misc_feature (5)..(5): 2'-deoxy-2'-fluoro
  misc_feature (6)..(6): 2'-O-methyl
  misc_feature (7)..(7): 2'-deoxy-2'-fluoro
  misc_feature (8)..(10): 2'-O-methyl
  misc_feature (11)..(12): 2'-deoxy-2'-fluoro
  misc_feature (13)..(19): 2'-O-methyl
  misc_feature (21)..(21): 3'-3 attached inverted deoxy abasic
cuugcguaaaccaaaaaaatt

SEQ ID NO: 2688 - DNA, 21 bp, Artificial Sequence
  Synthetic
  misc_feature (1)..(19): ribonucleotide modified as described
  misc_feature (1)..(1): 5'-3 attached inverted deoxy abasic
  misc_feature (1)..(3): 2'-O-methyl
  misc_feature (4)..(4): 2'-deoxy-2'-fluoro
  misc_feature (5)..(7): 2'-O-methyl
  misc_feature (8)..(8): 2'-deoxy-2'-fluoro
  misc_feature (9)..(13): 2'-O-methyl
  misc_feature (14)..(16): 2'-deoxy-2'-fluoro
  misc_feature (17)..(18): 2'-O-methyl
  misc_feature (19)..(19): 2'-deoxy-2'-fluoro
  misc_feature (21)..(21): 3'-3 attached inverted deoxy abasic
gggcaaauaagaauuugautt

SEQ ID NO: 2689 - DNA, 21 bp, Artificial Sequence
  Synthetic
  misc_feature (1)..(19): ribonucleotide modified as described
  misc_feature (1)..(1): 5'-3 attached inverted deoxy abasic
  misc_feature (1)..(4): 2'-deoxy-2'-fluoro
  misc_feature (5)..(10): 2'-O-methyl
  misc_feature (11)..(12): 2'-deoxy-2'-fluoro
  misc_feature (13)..(15): 2'-O-methyl
  misc_feature (16)..(16): 2'-deoxy-2'-fluoro
  misc_feature (17)..(18): 2'-O-methyl
  misc_feature (19)..(19): 2'-deoxy-2'-fluoro
  misc_feature (21)..(21): 3'-3 attached inverted deoxy abasic
cuccaaaaaacuaagugautt

SEQ ID NO: 2690 - DNA, 21 bp, Artificial Sequence
  Synthetic
  misc_feature (1)..(19): ribonucleotide modified as described
  misc_feature (1)..(1): 5'-3 attached inverted deoxy abasic
  misc_feature (1)..(2): 2'-O-methyl
  misc_feature (3)..(4): 2'-deoxy-2'-fluoro
  misc_feature (5)..(6): 2'-O-methyl
  misc_feature (7)..(8): 2'-deoxy-2'-fluoro
  misc_feature (9)..(9): 2'-O-methyl
  misc_feature (10)..(10): 2'-deoxy-2'-fluoro
  misc_feature (11)..(14): 2'-O-methyl
  misc_feature (15)..(15): 2'-deoxy-2'-fluoro
  misc_feature (16)..(19): 2'-O-methyl
  misc_feature (21)..(21): 3'-3 attached inverted deoxy abasic
ggucaacuaugaaaugaaatt

SEQ ID NO: 2691 - DNA, 21 bp, Artificial Sequence
  Synthetic
  misc_feature (1)..(19): ribonucleotide modified as described
  misc_feature (1)..(1): 5'-3 attached inverted deoxy abasic
  misc_feature (1)..(4): 2'-O-methyl
  misc_feature (5)..(5): 2'-deoxy-2'-fluoro
  misc_feature (6)..(6): 2'-O-methyl
  misc_feature (7)..(8): 2'-deoxy-2'-fluoro
  misc_feature (9)..(11): 2'-O-methyl
  misc_feature (12)..(12): 2'-deoxy-2'-fluoro
  misc_feature (13)..(13): 2'-O-methyl
  misc_feature (14)..(14): 2'-deoxy-2'-fluoro
  misc_feature (15)..(19): 2'-O-methyl
  misc_feature (21)..(21): 3'-3 attached inverted deoxy abasic
gaagcacuaaauacaaaaatt

SEQ ID NO: 2692 - DNA, 21 bp, Artificial Sequence
  Synthetic
  misc_feature (1)..(19): ribonucleotide modified as described
  misc_feature (1)..(1): 5'-3 attached inverted deoxy abasic
  misc_feature (1)..(5): 2'-deoxy-2'-fluoro
  misc_feature (6)..(6): 2'-O-methyl
  misc_feature (7)..(7): 2'-deoxy-2'-fluoro
  misc_feature (8)..(9): 2'-O-methyl
  misc_feature (10)..(10): 2'-deoxy-2'-fluoro
  misc_feature (11)..(11): 2'-O-methyl
  misc_feature (12)..(12): 2'-deoxy-2'-fluoro
  misc_feature (13)..(13): 2'-O-methyl
  misc_feature (14)..(14): 2'-deoxy-2'-fluoro
  misc_feature (15)..(17): 2'-O-methyl
  misc_feature (18)..(18): 2'-deoxy-2'-fluoro
  misc_feature (19)..(19): 2'-O-methyl
  misc_feature (21)..(21): 3'-3 attached inverted deoxy abasic
cucccauaauauacaaguatt

SEQ ID NO: 2693 - DNA, 21 bp, Artificial Sequence
  Synthetic
  misc_feature (1)..(19): ribonucleotide modified as described
  misc_feature (1)..(1): 5'-3 attached inverted deoxy abasic
  misc_feature (1)..(1): 2'-deoxy-2'-fluoro
  misc_feature (2)..(2): 2'-O-methyl
  misc_feature (3)..(5): 2'-deoxy-2'-fluoro
  misc_feature (6)..(7): 2'-O-methyl
  misc_feature (8)..(8): 2'-deoxy-2'-fluoro
  misc_feature (9)..(11): 2'-O-methyl
  misc_feature (12)..(12): 2'-deoxy-2'-fluoro
  misc_feature (13)..(13): 2'-O-methyl
  misc_feature (14)..(14): 2'-deoxy-2'-fluoro
  misc_feature (15)..(15): 2'-O-methyl
  misc_feature (16)..(17): 2'-deoxy-2'-fluoro
  misc_feature (18)..(18): 2'-O-methyl
  misc_feature (19)..(19): 2'-deoxy-2'-fluoro
  misc_feature (21)..(21): 3'-3 attached inverted deoxy abasic
cauccagcaaauacaccautt

SEQ ID NO: 2694 - DNA, 21 bp, Artificial Sequence
  Synthetic
  misc_feature (1)..(19): ribonucleotide modified as described
  misc_feature (1)..(1): 5'-3 attached inverted deoxy abasic
  misc_feature (1)..(1): 2'-deoxy-2'-fluoro
  misc_feature (2)..(3): 2'-O-methyl
  misc_feature (4)..(8): 2'-deoxy-2'-fluoro
  misc_feature (9)..(9): 2'-O-methyl
  misc_feature (10)..(10): 2'-deoxy-2'-fluoro
  misc_feature (11)..(14): 2'-O-methyl
  misc_feature (15)..(15): 2'-deoxy-2'-fluoro
  misc_feature (16)..(16): 2'-O-methyl
  misc_feature (17)..(19): 2'-deoxy-2'-fluoro
  misc_feature (21)..(21): 3'-3 attached inverted deoxy abasic
cagcuucuaugaaguguuutt

SEQ ID NO: 2695 - DNA, 21 bp, Artificial Sequence
  Synthetic
  misc_feature (1)..(19): ribonucleotide modified as described
  misc_feature (1)..(7): 2'-deoxy-2'-fluoro
  misc_feature (8)..(9): 2'-O-methyl
  misc_feature (10)..(12): 2'-deoxy-2'-fluoro
  misc_feature (13)..(13): 2'-O-methyl
  misc_feature (14)..(14): 2'-deoxy-2'-fluoro
  misc_feature (15)..(15): 2'-O-methyl
  misc_feature (16)..(16): 2'-deoxy-2'-fluoro
  misc_feature (17)..(19): 2'-O-methyl
  misc_feature (20)..(21): phosphorothioate linkage
uuuuuuugguuuacgcaagtt

SEQ ID NO: 2696 - DNA, 21 bp, Artificial Sequence
  Synthetic
  misc_feature (1)..(19): ribonucleotide modified as described
  misc_feature (1)..(1): 2'-O-methyl
  misc_feature (2)..(3): 2'-deoxy-2'-fluoro
  misc_feature (4)..(6): 2'-O-methyl
  misc_feature (7)..(11): 2'-deoxy-2'-fluoro
  misc_feature (12)..(12): 2'-O-methyl
  misc_feature (13)..(15): 2'-deoxy-2'-fluoro
  misc_feature (16)..(16): 2'-O-methyl
  misc_feature (17)..(19): 2'-deoxy-2'-fluoro
  misc_feature (20)..(21): phosphorothioate linkage
aucaaauucuuauuugccctt

SEQ ID NO: 2697 - DNA, 21 bp, Artificial Sequence
  Synthetic
  misc_feature (1)..(19): ribonucleotide modified as described
  misc_feature (1)..(1): 2'-O-methyl
  misc_feature (2)..(3): 2'-deoxy-2'-fluoro
  misc_feature (4)..(4): 2'-O-methyl
  misc_feature (5)..(7): 2'-deoxy-2'-fluoro
  misc_feature (8)..(9): 2'-O-methyl
  misc_feature (10)..(15): 2'-deoxy-2'-fluoro
  misc_feature (16)..(19): 2'-O-methyl
  misc_feature (20)..(21): phosphorothioate linkage
aucacuuaguuuuuuggagtt

SEQ ID NO: 2698 - DNA, 21 bp, Artificial Sequence
  Synthetic
  misc_feature (1)..(19): ribonucleotide modified as described
  misc_feature (1)..(4): 2'-deoxy-2'-fluoro
  misc_feature (5)..(5): 2'-O-methyl
  misc_feature (6)..(9): 2'-deoxy-2'-fluoro
  misc_feature (10)..(10): 2'-O-methyl
  misc_feature (11)..(11): 2'-deoxy-2'-fluoro
  misc_feature (12)..(13): 2'-O-methyl
  misc_feature (14)..(15): 2'-deoxy-2'-fluoro
  misc_feature (16)..(17): 2'-O-methyl
  misc_feature (18)..(19): 2'-deoxy-2'-fluoro
  misc_feature (20)..(21): phosphorothioate linkage
uuucauuucauaguugacctt

SEQ ID NO: 2699 - DNA, 21 bp, Artificial Sequence
  Synthetic
  misc_feature (1)..(19): ribonucleotide modified as described
  misc_feature (1)..(5): 2'-deoxy-2'-fluoro
  misc_feature (6)..(6): 2'-O-methyl
  misc_feature (7)..(7): 2'-deoxy-2'-fluoro
  misc_feature (8)..(8): 2'-O-methyl
  misc_feature (9)..(11): 2'-deoxy-2'-fluoro
  misc_feature (12)..(13): 2'-O-methyl
  misc_feature (14)..(14): 2'-deoxy-2'-fluoro
  misc_feature (15)..(15): 2'-O-methyl
  misc_feature (16)..(19): 2'-deoxy-2'-fluoro
  misc_feature (20)..(21): phosphorothioate linkage
uuuuuguauuuagugcuuctt

SEQ ID NO: 2700 - DNA, 21 bp, Artificial Sequence
  Synthetic
  misc_feature (1)..(19): ribonucleotide modified as described
  misc_feature (1)..(1): 2'-deoxy-2'-fluoro
  misc_feature (2)..(2): 2'-O-methyl
  misc_feature (3)..(5): 2'-deoxy-2'-fluoro
  misc_feature (6)..(6): 2'-O-methyl
  misc_feature (7)..(7): 2'-deoxy-2'-fluoro
  misc_feature (8)..(8): 2'-O-methyl
  misc_feature (9)..(9): 2'-deoxy-2'-fluoro
  misc_feature (10)..(10): 2'-O-methyl
  misc_feature (11)..(12): 2'-deoxy-2'-fluoro
  misc_feature (13)..(13): 2'-O-methyl
  misc_feature (14)..(14): 2'-deoxy-2'-fluoro
  misc_feature (15)..(19): 2'-O-methyl
  misc_feature (20)..(21): phosphorothioate linkage
uacuuguauauuaugggagtt

SEQ ID NO: 2701 - DNA, 21 bp, Artificial Sequence
  Synthetic
  misc_feature (1)..(19): ribonucleotide modified as described
  misc_feature (1)..(1): 2'-O-methyl
  misc_feature (2)..(2): 2'-deoxy-2'-fluoro
  misc_feature (3)..(4): 2'-O-methyl
  misc_feature (5)..(5): 2'-deoxy-2'-fluoro
  misc_feature (6)..(6): 2'-O-methyl
  misc_feature (7)..(7): 2'-deoxy-2'-fluoro
  misc_feature (8)..(8): 2'-O-methyl
  misc_feature (9)..(11): 2'-deoxy-2'-fluoro
  misc_feature (12)..(12): 2'-O-methyl
  misc_feature (13)..(14): 2'-deoxy-2'-fluoro
  misc_feature (15)..(17): 2'-O-methyl
  misc_feature (18)..(18): 2'-deoxy-2'-fluoro
  misc_feature (19)..(19): 2'-O-methyl
  misc_feature (20)..(21): phosphorothioate linkage
augguguauuugcuggaugtt

SEQ ID NO: 2702 - DNA, 21 bp, Artificial Sequence
  Synthetic
  misc_feature (1)..(19): ribonucleotide modified as described
  misc_feature (1)..(3): 2'-O-methyl
  misc_feature (4)..(4): 2'-deoxy-2'-fluoro
  misc_feature (5)..(5): 2'-O-methyl
  misc_feature (6)..(9): 2'-deoxy-2'-fluoro
  misc_feature (10)..(10): 2'-O-methyl
  misc_feature (11)..(11): 2'-deoxy-2'-fluoro
  misc_feature (12)..(16): 2'-O-methyl
  misc_feature (17)..(18): 2'-deoxy-2'-fluoro
  misc_feature (19)..(19): 2'-O-methyl
  misc_feature (20)..(21): phosphorothioate linkage
aaacacuucauagaagcugtt

SEQ ID NO: 2703 - DNA, 21 bp, Artificial Sequence
  Synthetic
  misc_feature (1)..(19): ribonucleotide modified as described
  misc_feature (1)..(1): 5'-3 attached inverted deoxy abasic
  misc_feature (21)..(21): 3'-3 attached inverted deoxy abasic
cuugcguaaaccaaaaaaatt

SEQ ID NO: 2704 - DNA, 21 bp, Artificial Sequence
  Synthetic
  misc_feature (1)..(19): ribonucleotide modified as described
  misc_feature (1)..(1): 5'-3 attached inverted deoxy abasic
  misc_feature (21)..(21): 3'-3 attached inverted deoxy abasic
gggcaaauaagaauuugautt

SEQ ID NO: 2705 - DNA, 21 bp, Artificial Sequence
  Synthetic
  misc_feature (1)..(19): ribonucleotide modified as described
  misc_feature (1)..(1): 5'-3 attached inverted deoxy abasic
  misc_feature (21)..(21): 3'-3 attached inverted deoxy abasic
cuccaaaaaacuaagugautt

SEQ ID NO: 2706 - DNA, 21 bp, Artificial Sequence
  Synthetic
  misc_feature (1)..(19): ribonucleotide modified as described
  misc_feature (1)..(1): 5'-3 attached inverted deoxy abasic
  misc_feature (21)..(21): 3'-3 attached inverted deoxy abasic
ggucaacuaugaaaugaaatt

SEQ ID NO: 2707 - DNA, 21 bp, Artificial Sequence
  Synthetic
  misc_feature (1)..(19): ribonucleotide modified as described
  misc_feature (1)..(1): 5'-3 attached inverted deoxy abasic
  misc_feature (21)..(21): 3'-3 attached inverted deoxy abasic
gaagcacuaaauacaaaaatt

SEQ ID NO: 2708 - DNA, 21 bp, Artificial Sequence
  Synthetic
  misc_feature (1)..(19): ribonucleotide modified as described
  misc_feature (1)..(1): 5'-3 attached inverted deoxy abasic
  misc_feature (21)..(21): 3'-3 attached inverted deoxy abasic
cucccauaauauacaaguatt

SEQ ID NO: 2709 - DNA, 21 bp, Artificial Sequence
  Synthetic
  misc_feature (1)..(19): ribonucleotide modified as described
  misc_feature (1)..(1): 5'-3 attached inverted deoxy abasic
  misc_feature (21)..(21): 3'-3 attached inverted deoxy abasic
cauccagcaaauacaccautt

SEQ ID NO: 2710 - DNA, 21 bp, Artificial Sequence
  Synthetic
  misc_feature (1)..(19): ribonucleotide modified as described
  misc_feature (1)..(1): 5'-3 attached inverted deoxy abasic
  misc_feature (21)..(21): 3'-3 attached inverted deoxy abasic
cagcuucuaugaaguguuutt

SEQ ID NO: 2711 - DNA, 21 bp, Artificial Sequence
  Synthetic
  misc_feature (1)..(19): ribonucleotide modified as described
  misc_feature (20)..(21): phosphorothioate linkage
uuuuuuugguuuacgcaagtt

SEQ ID NO: 2712 - DNA, 21 bp, Artificial Sequence
  Synthetic
  misc_feature (1)..(19): ribonucleotide modified as described
  misc_feature (20)..(21): phosphorothioate linkage
aucaaauucuuauuugccctt

SEQ ID NO: 2713 - DNA, 21 bp, Artificial Sequence
  Synthetic
  misc_feature (1)..(19): ribonucleotide modified as described
  misc_feature (20)..(21): phosphorothioate linkage
aucacuuaguuuuuuggagtt

SEQ ID NO: 2714 - DNA, 21 bp, Artificial Sequence
  Synthetic
  misc_feature (1)..(19): ribonucleotide modified as described
  misc_feature (20)..(21): phosphorothioate linkage
uuucauuucauaguugacctt

SEQ ID NO: 2715 - DNA, 21 bp, Artificial Sequence
  Synthetic
  misc_feature (1)..(19): ribonucleotide modified as described
  misc_feature (20)..(21): phosphorothioate linkage
uuuuuguauuuagugcuuctt

SEQ ID NO: 2716 - DNA, 21 bp, Artificial Sequence
  Synthetic
  misc_feature (1)..(19): ribonucleotide modified as described
  misc_feature (20)..(21): phosphorothioate linkage
uacuuguauauuaugggagtt

SEQ ID NO: 2717 - DNA, 21 bp, Artificial Sequence
  Synthetic
  misc_feature (1)..(19): ribonucleotide modified as described
  misc_feature (20)..(21): phosphorothioate linkage
augguguauuugcuggaugtt

SEQ ID NO: 2718 - DNA, 21 bp, Artificial Sequence
  Synthetic
  misc_feature (1)..(19): ribonucleotide modified as described
  misc_feature (20)..(21): phosphorothioate linkage
aaacacuucauagaagcugtt

SEQ ID NO: 2719 - DNA, 21 bp, Artificial Sequence
  Synthetic
  misc_feature (1)..(19): ribonucleotide modified as described
  misc_feature (1)..(7): 2'-deoxy-2'-fluoro
  misc_feature (8)..(9): 2'-O-methyl
  misc_feature (10)..(12): 2'-deoxy-2'-fluoro
  misc_feature (13)..(13): 2'-O-methyl
  misc_feature (14)..(14): 2'-deoxy-2'-fluoro
  misc_feature (15)..(15): 2'-O-methyl
  misc_feature (16)..(16): 2'-deoxy-2'-fluoro
  misc_feature (17)..(19): 2'-O-methyl
  misc_feature (21)..(21): 3'-3 attached inverted deoxy abasic
uuuuuuugguuuacgcaagtt

SEQ ID NO: 2720 - DNA, 21 bp, Artificial Sequence
  Synthetic
  misc_feature (1)..(19): ribonucleotide modified as described
  misc_feature (1)..(1): 2'-O-methyl
  misc_feature (2)..(3): 2'-deoxy-2'-fluoro
  misc_feature (4)..(6): 2'-O-methyl
  misc_feature (7)..(11): 2'-deoxy-2'-fluoro
  misc_feature (12)..(12): 2'-O-methyl
  misc_feature (13)..(15): 2'-deoxy-2'-fluoro
  misc_feature (16)..(16): 2'-O-methyl
  misc_feature (17)..(19): 2'-deoxy-2'-fluoro
  misc_feature (21)..(21): 3'-3 attached inverted deoxy abasic
aucaaauucuuauuugccctt

SEQ ID NO: 2721 - DNA, 21 bp, Artificial Sequence
  Synthetic
  misc_feature (1)..(19): ribonucleotide modified as described
  misc_feature (1)..(1): 2'-O-methyl
  misc_feature (2)..(3): 2'-deoxy-2'-fluoro
  misc_feature (4)..(4): 2'-O-methyl
  misc_feature (5)..(7): 2'-deoxy-2'-fluoro
  misc_feature (8)..(9): 2'-O-methyl
  misc_feature (10)..(15): 2'-deoxy-2'-fluoro
  misc_feature (16)..(19): 2'-O-methyl
  misc_feature (21)..(21): 3'-3 attached inverted deoxy abasic
aucacuuaguuuuuuggagtt

SEQ ID NO: 2722 - DNA, 21 bp, Artificial Sequence
  Synthetic
  misc_feature (1)..(19): ribonucleotide modified as described
  misc_feature (1)..(4): 2'-deoxy-2'-fluoro
  misc_feature (5)..(5): 2'-O-methyl
  misc_feature (6)..(9): 2'-deoxy-2'-fluoro
  misc_feature (10)..(10): 2'-O-methyl
  misc_feature (11)..(11): 2'-deoxy-2'-fluoro
  misc_feature (12)..(13): 2'-O-methyl
  misc_feature (14)..(15): 2'-deoxy-2'-fluoro
  misc_feature (16)..(17): 2'-O-methyl
  misc_feature (18)..(19): 2'-deoxy-2'-fluoro
  misc_feature (21)..(21): 3'-3 attached inverted deoxy abasic
uuucauuucauaguugacctt

SEQ ID NO: 2723 - DNA, 21 bp, Artificial Sequence
  Synthetic
  misc_feature (1)..(19): ribonucleotide modified as described
  misc_feature (1)..(5): 2'-deoxy-2'-fluoro
  misc_feature (6)..(6): 2'-O-methyl
  misc_feature (7)..(7): 2'-deoxy-2'-fluoro
  misc_feature (8)..(8): 2'-O-methyl
  misc_feature (9)..(11): 2'-deoxy-2'-fluoro
  misc_feature (12)..(13): 2'-O-methyl
  misc_feature (14)..(14): 2'-deoxy-2'-fluoro
  misc_feature (15)..(15): 2'-O-methyl
  misc_feature (16)..(19): 2'-deoxy-2'-fluoro
  misc_feature (21)..(21): 3'-3 attached inverted deoxy abasic
uuuuuguauuuagugcuuctt

SEQ ID NO: 2724 - DNA, 21 bp, Artificial Sequence
  Synthetic
  misc_feature (1)..(19): ribonucleotide modified as described
  misc_feature (1)..(1): 2'-deoxy-2'-fluoro
  misc_feature (2)..(2): 2'-O-methyl
  misc_feature (3)..(5): 2'-deoxy-2'-fluoro
  misc_feature (6)..(6): 2'-O-methyl
  misc_feature (7)..(7): 2'-deoxy-2'-fluoro
  misc_feature (8)..(8): 2'-O-methyl
  misc_feature (9)..(9): 2'-deoxy-2'-fluoro
  misc_feature (10)..(10): 2'-O-methyl
  misc_feature (11)..(12): 2'-deoxy-2'-fluoro
  misc_feature (13)..(13): 2'-O-methyl
  misc_feature (14)..(14): 2'-deoxy-2'-fluoro
  misc_feature (15)..(19): 2'-O-methyl
  misc_feature (21)..(21): 3'-3 attached inverted deoxy abasic
uacuuguauauuaugggagtt

SEQ ID NO: 2725 - DNA, 21 bp, Artificial Sequence
  Synthetic
  misc_feature (1)..(19): ribonucleotide modified as described
  misc_feature (1)..(1): 2'-O-methyl
  misc_feature (2)..(2): 2'-deoxy-2'-fluoro
  misc_feature (3)..(4): 2'-O-methyl
  misc_feature (5)..(5): 2'-deoxy-2'-fluoro
  misc_feature (6)..(6): 2'-O-methyl
  misc_feature (7)..(7): 2'-deoxy-2'-fluoro
  misc_feature (8)..(8): 2'-O-methyl
  misc_feature (9)..(11): 2'-deoxy-2'-fluoro
  misc_feature (12)..(12): 2'-O-methyl
  misc_feature (13)..(14): 2'-deoxy-2'-fluoro
  misc_feature (15)..(17): 2'-O-methyl
  misc_feature (18)..(18): 2'-deoxy-2'-fluoro
  misc_feature (19)..(19): 2'-O-methyl
  misc_feature (21)..(21): 3'-3 attached inverted deoxy abasic
augguguauuugcuggaugtt

SEQ ID NO: 2726 - DNA, 21 bp, Artificial Sequence
  Synthetic
  misc_feature (1)..(19): ribonucleotide modified as described
  misc_feature (1)..(3): 2'-O-methyl
  misc_feature (4)..(4): 2'-deoxy-2'-fluoro
  misc_feature (5)..(5): 2'-O-methyl
  misc_feature (6)..(9): 2'-deoxy-2'-fluoro
  misc_feature (10)..(10): 2'-O-methyl
  misc_feature (11)..(11): 2'-deoxy-2'-fluoro
  misc_feature (12)..(16): 2'-O-methyl
  misc_feature (17)..(18): 2'-deoxy-2'-fluoro
  misc_feature (19)..(19): 2'-O-methyl
  misc_feature (21)..(21): 3'-3 attached inverted deoxy abasic
aaacacuucauagaagcugtt

SEQ ID NO: 2727 - DNA, 21 bp, Artificial Sequence
  Synthetic
  misc_feature (1)..(19): ribonucleotide modified as described
  misc_feature (21)..(21): 3'-3 attached inverted deoxy abasic
uuuuuuugguuuacgcaagtt

SEQ ID NO: 2728 - DNA, 21 bp, Artificial Sequence
  Synthetic
  misc_feature (1)..(19): ribonucleotide modified as described
  misc_feature (21)..(21): 3'-3 attached inverted deoxy abasic
aucaaauucuuauuugccctt

SEQ ID NO: 2729 - DNA, 21 bp, Artificial Sequence
  Synthetic
  misc_feature (1)..(19): ribonucleotide modified as described
  misc_feature (21)..(21): 3'-3 attached inverted deoxy abasic
aucacuuaguuuuuuggagtt

SEQ ID NO: 2730 - DNA, 21 bp, Artificial Sequence
  Synthetic
  misc_feature (1)..(19): ribonucleotide modified as described
  misc_feature (21)..(21): 3'-3 attached inverted deoxy abasic
uuucauuucauaguugacctt

SEQ ID NO: 2731 - DNA, 21 bp, Artificial Sequence
  Synthetic
  misc_feature (1)..(19): ribonucleotide modified as described
  misc_feature (21)..(21): 3'-3 attached inverted deoxy abasic
uuuuuguauuuagugcuuctt

SEQ ID NO: 2732 - DNA, 21 bp, Artificial Sequence
  Synthetic
  misc_feature (1)..(19): ribonucleotide modified as described
  misc_feature (21)..(21): 3'-3 attached inverted deoxy abasic
uacuuguauauuaugggagtt

SEQ ID NO: 2733 - DNA, 21 bp, Artificial Sequence
  Synthetic
  misc_feature (1)..(19): ribonucleotide modified as described
  misc_feature (21)..(21): 3'-3 attached inverted deoxy abasic
augguguauuugcuggaugtt

SEQ ID NO: 2734 - DNA, 21 bp, Artificial Sequence
  Synthetic
  misc_feature (1)..(19): ribonucleotide modified as described
  misc_feature (21)..(21): 3'-3 attached inverted deoxy abasic
aaacacuucauagaagcugtt

SEQ ID NO: 2735 - DNA, 21 bp, Artificial Sequence
  Synthetic
  misc_feature (1)..(19): ribonucleotide modified as described
  misc_feature (4)..(7): 2'-deoxy-2'-fluoro
  misc_feature (8)..(9): 2'-O-methyl
  misc_feature (10)..(12): 2'-deoxy-2'-fluoro
  misc_feature (13)..(13): 2'-O-methyl
  misc_feature (14)..(14): 2'-deoxy-2'-fluoro
  misc_feature (15)..(15): 2'-O-methyl
  misc_feature (16)..(16): 2'-deoxy-2'-fluoro
  misc_feature (17)..(19): 2'-O-methyl
  misc_feature (20)..(21): phosphorothioate linkage
uuuuuuugguuuacgcaagtt

SEQ ID NO: 2736 - DNA, 21 bp, Artificial Sequence
  Synthetic
  misc_feature (1)..(19): ribonucleotide modified as described
  misc_feature (4)..(6): 2'-O-methyl
  misc_feature (7)..(11): 2'-deoxy-2'-fluoro
  misc_feature (12)..(12): 2'-O-methyl
  misc_feature (13)..(15): 2'-deoxy-2'-fluoro
  misc_feature (16)..(16): 2'-O-methyl
  misc_feature (17)..(19): 2'-deoxy-2'-fluoro
  misc_feature (20)..(21): phosphorothioate linkage
aucaaauucuuauuugccctt

SEQ ID NO: 2737 - DNA, 21 bp, Artificial Sequence
  Synthetic
  misc_feature (1)..(19): ribonucleotide modified as described
  misc_feature (4)..(4): 2'-O-methyl
  misc_feature (5)..(7): 2'-deoxy-2'-fluoro
  misc_feature (8)..(9): 2'-O-methyl
  misc_feature (10)..(15): 2'-deoxy-2'-fluoro
  misc_feature (16)..(19): 2'-O-methyl
  misc_feature (20)..(21): phosphorothioate linkage
aucacuuaguuuuuuggagtt

SEQ ID NO: 2738 - DNA, 21 bp, Artificial Sequence
  Synthetic
  misc_feature (1)..(19): ribonucleotide modified as described
  misc_feature (4)..(4): 2'-deoxy-2'-fluoro
  misc_feature (5)..(5): 2'-O-methyl
  misc_feature (6)..(9): 2'-deoxy-2'-fluoro
  misc_feature (10)..(10): 2'-O-methyl
  misc_feature (11)..(11): 2'-deoxy-2'-fluoro
  misc_feature (12)..(13): 2'-O-methyl
  misc_feature (14)..(15): 2'-deoxy-2'-fluoro
  misc_feature (16)..(17): 2'-O-methyl
  misc_feature (18)..(19): 2'-deoxy-2'-fluoro
  misc_feature (20)..(21): phosphorothioate linkage
uuucauuucauaguugacctt

SEQ ID NO: 2739 - DNA, 21 bp, Artificial Sequence
  Synthetic
  misc_feature (1)..(19): ribonucleotide modified as described
  misc_feature (4)..(5): 2'-deoxy-2'-fluoro
  misc_feature (6)..(6): 2'-O-methyl
  misc_feature (7)..(7): 2'-deoxy-2'-fluoro
  misc_feature (8)..(8): 2'-O-methyl
  misc_feature (9)..(11): 2'-deoxy-2'-fluoro
  misc_feature (12)..(13): 2'-O-methyl
  misc_feature (14)..(14): 2'-deoxy-2'-fluoro
  misc_feature (15)..(15): 2'-O-methyl
  misc_feature (16)..(19): 2'-deoxy-2'-fluoro
  misc_feature (20)..(21): phosphorothioate linkage
uuuuuguauuuagugcuuctt

SEQ ID NO: 2740 - DNA, 21 bp, Artificial Sequence
  Synthetic
  misc_feature (1)..(19): ribonucleotide modified as described
  misc_feature (4)..(5): 2'-deoxy-2'-fluoro
  misc_feature (6)..(6): 2'-O-methyl
  misc_feature (7)..(7): 2'-deoxy-2'-fluoro
  misc_feature (8)..(8): 2'-O-methyl
  misc_feature (9)..(9): 2'-deoxy-2'-fluoro
  misc_feature (10)..(10): 2'-O-methyl
  misc_feature (11)..(12): 2'-deoxy-2'-fluoro
  misc_feature (13)..(13): 2'-O-methyl
  misc_feature (14)..(14): 2'-deoxy-2'-fluoro
  misc_feature (15)..(19): 2'-O-methyl
  misc_feature (20)..(21): phosphorothioate linkage
uacuuguauauuaugggagtt

SEQ ID NO: 2741 - DNA, 21 bp, Artificial Sequence
  Synthetic
  misc_feature (1)..(19): ribonucleotide modified as described
  misc_feature (4)..(4): 2'-O-methyl
  misc_feature (5)..(5): 2'-deoxy-2'-fluoro
  misc_feature (6)..(6): 2'-O-methyl
  misc_feature (7)..(7): 2'-deoxy-2'-fluoro
  misc_feature (8)..(8): 2'-O-methyl
  misc_feature (9)..(11): 2'-deoxy-2'-fluoro
  misc_feature (12)..(12): 2'-O-methyl
  misc_feature (13)..(14): 2'-deoxy-2'-fluoro
  misc_feature (15)..(17): 2'-O-methyl
  misc_feature (18)..(18): 2'-deoxy-2'-fluoro
  misc_feature (19)..(19): 2'-O-methyl
  misc_feature (20)..(21): phosphorothioate linkage
augguguauuugcuggaugtt

SEQ ID NO: 2742 - DNA, 21 bp, Artificial Sequence
  Synthetic
  misc_feature (1)..(19): ribonucleotide modified as described
  misc_feature (4)..(4): 2'-deoxy-2'-fluoro
  misc_feature (5)..(5): 2'-O-methyl
  misc_feature (6)..(9): 2'-deoxy-2'-fluoro
  misc_feature (10)..(10): 2'-O-methyl
  misc_feature (11)..(11): 2'-deoxy-2'-fluoro
  misc_feature (12)..(16): 2'-O-methyl
  misc_feature (17)..(18): 2'-deoxy-2'-fluoro
  misc_feature (19)..(19): 2'-O-methyl
  misc_feature (20)..(21): phosphorothoiate linkage
aaacacuucauagaagcugtt

SEQ ID NO: 2743 - DNA, 21 bp, Artificial Sequence
  Synthetic
  misc_feature (1)..(1): optional abasic, inverted abasic, inverted nucleotide or other terminal cap
  misc_feature (21)..(21): optional abasic, inverted abasic, inverted nucleotide or other terminal cap
  misc_feature (1)..(19): ribonucleotide modified as described
  misc_feature (20)..(21): n stands for any nucleotide
nnnnnnnnnnnnnnnnnnnnn

SEQ ID NO: 2744 - DNA, 21 bp, Artificial Sequence
  Synthetic
  misc_feature (1)..(19): ribonucleotide modified as described
  misc_feature (20)..(21): Phosphorothioate 3'-Internucleotide Linkage
  misc_feature (20)..(21): n stands for any nucleotide
  misc_feature (21)..(21): 3'-3 attached terminal glyceryl moiety
nnnnnnnnnnnnnnnnnnnnn

SEQ ID NO: 2745 - DNA, 21 bp, Artificial Sequence
  Synthetic
  misc_feature (1)..(19): n is any ribonucleotide wherein any pyrimidine is 2'-Fluoro and any purine is 2'-O-methyl
  misc_feature (20)..(21): n stands for any nucleotide
nnnnnnnnnnnnnnnnnnnnn

SEQ ID NO: 2746 - DNA, 21 bp, Artificial Sequence
  Synthetic
  misc_feature (1)..(19): n is any ribonucleotide wherein any pyrimidine is 2'-Fluoro or -OCF3 and any purine is 2'-O-methyl
  misc_feature (20)..(21): n stands for any nucleotide
  misc_feature (20)..(21): optional phosphorothioate or phosphorodithioate linkage
  misc_feature (21)..(21): 3'-3 attached terminal glyceryl moiety
nnnnnnnnnnnnnnnnnnnnn

SEQ ID NO: 2747 - DNA, 21 bp, Artificial Sequence
  Synthetic
  misc_feature (1)..(19): n is any ribonucleotide wherein any pyrimidine is 2'-OCF3 or 2'-Fluoro
  misc_feature (20)..(21): n stands for any nucleotide
  misc_feature (1)..(1): optional abasic, inverted abasic, inverted nucleotide or other terminal cap
  misc_feature (21)..(21): optional abasic, inverted abasic, inverted nucleotide or other terminal cap
nnnnnnnnnnnnnnnnnnnnn

SEQ ID NO: 2748 - DNA, 21 bp, Artificial Sequence
  Synthetic
  misc_feature (1)..(19): n is any ribonucleotide wherein any pyrimidine is 2'-Fluoro or 2'-OCF3
  misc_feature (20)..(20): Phosphorothioate 3'-Internucleotide Linkage
  misc_feature (20)..(21): n stands for any nucleotide
  misc_feature (21)..(21): 3'-3 attached terminal glyceryl moiety
nnnnnnnnnnnnnnnnnnnnn

SEQ ID NO: 2749 - DNA, 21 bp, Artificial Sequence
  Synthetic
  misc_feature (1)..(19): n is any ribonucleotide wherein any pyrimidine is 2'-Fluoro or -OCF3 and any purine is 2'-Deoxy
  misc_feature (20)..(21): n stands for any nucleotide
  misc_feature (1)..(1): optional abasic, inverted abasic, inverted nucleotide or other terminal cap
  misc_feature (21)..(21): optional abasic, inverted abasic, inverted nucleotide or other terminal cap
nnnnnnnnnnnnnnnnnnnnn

SEQ ID NO: 2750 - DNA, 21 bp, Artificial Sequence
  Synthetic
  misc_feature (1)..(19): n is any ribonucleotide wherein any pyrimidine is 2'-Fluoro
  misc_feature (20)..(21): n stands for any nucleotide
  misc_feature (1)..(1): 5'-3 attached terminal deoxyabasic moiety
  misc_feature (21)..(21): 3'-3 attached terminal deoxyabasic moiety
nnnnnnnnnnnnnnnnnnnnn

SEQ ID NO: 2751 - DNA, 21 bp, Artificial Sequence
  Synthetic
  misc_feature (1)..(19): ribonucleotide modified as described
  misc_feature (1)..(1): optional abasic, inverted abasic, inverted nucleotide or other terminal cap
  misc_feature (20)..(21): n is any nucleotide
  misc_feature (21)..(21): optional abasic, inverted abasic, inverted nucleotide or other terminal cap
guuggagugcuagagaguunn

SEQ ID NO: 2752 - DNA, 21 bp, Artificial Sequence
  Synthetic
  misc_feature (1)..(19): ribonucleotide modified as described
  misc_feature (20)..(21): n is any nucleotide
  misc_feature (20)..(21): phosphorothioate or phosphorodithioate linkage
  misc_feature (21)..(21): optional glyceryl moiety attached
aacucucuagcacuccaacnn

SEQ ID NO: 2753 - DNA, 21 bp, Artificial Sequence
  Synthetic
  misc_feature (2)..(3): 2'-deoxy-2'-Fluoro or 2'-OCF3
  misc_feature (8)..(8): 2'-deoxy-2'-Fluoro or 2'-OCF3
  misc_feature (10)..(11): 2'-deoxy-2'-Fluoro or 2'-OCF3
  misc_feature (18)..(19): 2'-deoxy-2'-Fluoro or 2'-OCF3
  misc_feature (1)..(1): 2'-O-methyl
  misc_feature (4)..(7): 2'-O-methyl
  misc_feature (9)..(9): 2'-O-methyl
  misc_feature (12)..(17): 2'-O-methyl
  misc_feature (20)..(21): Phosphorothioate or Phosphorodithioate 3'-Internucleotide Linkage
  misc_feature (1)..(19): ribonucleotide modified as described
guuggagugcuagagaguunn

SEQ ID NO: 2754 - DNA, 21 bp, Artificial Sequence
  Synthetic
  misc_feature (3)..(8): 2'-deoxy-2'-Fluoro or 2'-OCF3
  misc_feature (11)..(11): 2'-deoxy-2'-Fluoro or 2'-OCF3
  misc_feature (13)..(16): 2'-deoxy-2'-Fluoro or 2'-OCF3
  misc_feature (19)..(19): 2'-deoxy-2'-Fluoro or 2'-OCF3
  misc_feature (1)..(2): 2'-O-Methyl
  misc_feature (9)..(10): 2'-O-Methyl
  misc_feature (12)..(12): 2'-O-Methyl
  misc_feature (17)..(18): 2'-O-Methyl
  misc_feature (20)..(21): Phosphorothioate 3'-Internucleotide Linkage
  misc_feature (20)..(21): n is any nucleotide
  misc_feature (1)..(19): ribonucleotide modified as described
aacucucuagcacuccaacnn

SEQ ID NO: 2755 - DNA, 21 bp, Artificial Sequence
  Synthetic
  misc_feature (2)..(3): 2'-deoxy-2'-Fluoro
  misc_feature (8)..(8): 2'-deoxy-2'-Fluoro
  misc_feature (10)..(11): 2'-deoxy-2'-Fluoro
  misc_feature (18)..(19): 2'-deoxy-2'-Fluoro
  misc_feature (1)..(19): ribonucleotide modified as described
  misc_feature (20)..(21): n is any nucleotide
  misc_feature (1)..(1): 5'-3 attached terminal deoxyabasic moiety
  misc_feature (21)..(21): 3'-3 attached terminal deoxyabasic moiety
guuggagugcuagagaguunn

SEQ ID NO: 2756 - DNA, 21 bp, Artificial Sequence
  Synthetic
  misc_feature (3)..(8): 2'-OCF3 or 2'-deoxy-2'-Fluoro
  misc_feature (11)..(11): 2'-OCF3 or 2'-deoxy-2'-Fluoro
  misc_feature (13)..(16): 2'-OCF3 or 2'-deoxy-2'-Fluoro
  misc_feature (19)..(19): 2'-OCF3 or 2'-deoxy-2'-Fluoro
  misc_feature (21)..(21): terminal glyceryl moiety
  misc_feature (20)..(21): n is any nucleotide
  misc_feature (20)..(21): phosphorothioate or phosphorodithioate linkage
  misc_feature (1)..(19): ribonucleotide modified as described
aacucucuagcacuccaacnn

SEQ ID NO: 2757 - DNA, 21 bp, Artificial Sequence
  Synthetic
  misc_feature (2)..(3): 2'-deoxy-2'-Fluoro or 2'-OCF3
  misc_feature (8)..(8): 2'-deoxy-2'-Fluoro or 2'-OCF3
  misc_feature (10)..(11): 2'-deoxy-2'-Fluoro or 2'-OCF3
  misc_feature (18)..(19): 2'-deoxy-2'-Fluoro or 2'-OCF3
  misc_feature (1)..(1): 2'-deoxy
  misc_feature (4)..(7): 2'-deoxy
  misc_feature (9)..(9): 2'-deoxy
  misc_feature (11)..(17): 2'-deoxy
  misc_feature (1)..(19): ribonucleotide modified as described
  misc_feature (1)..(1): 5'-3 attached terminal deoxyabasic moiety
  misc_feature (20)..(21): n is any nucleotide
  misc_feature (21)..(21): 3'-3 attached terminal deoxyabasic moiety
guuggagugcuagagaguunn

SEQ ID NO: 2758 - DNA, 21 bp, Artificial Sequence
  Synthetic
  misc_feature (2)..(3): 2'-deoxy-2'-Fluoro
  misc_feature (8)..(8): 2'-deoxy-2'-Fluoro
  misc_feature (10)..(11): 2'-deoxy-2'-Fluoro
  misc_feature (18)..(19): 2'-deoxy-2'-Fluoro
  misc_feature (1)..(1): 5'-3 attached terminal deoxyabasic moiety
  misc_feature (20)..(21): n is any nucleotide
  misc_feature (21)..(21): 3'-3 attached terminal deoxyabasic moiety
  misc_feature (1)..(19): ribonucleotide modified as described
guuggagugcuagagaguunn

SEQ ID NO: 2759 - DNA, 21 bp, Artificial Sequence
  Synthetic
  misc_feature (3)..(8): 2'-deoxy-2'-Fluoro or -OCF3
  misc_feature (11)..(11): 2'-deoxy-2'-Fluoro or -OCF3
  misc_feature (13)..(16): 2'-deoxy-2'-Fluoro or -OCF3
  misc_feature (19)..(19): 2'-deoxy-2'-Fluoro or -OCF3
  misc_feature (1)..(2): 2'-deoxy
  misc_feature (9)..(10): 2'-deoxy
  misc_feature (12)..(12): 2'-deoxy
  misc_feature (17)..(18): 2'-deoxy
  misc_feature (20)..(21): phosphorothioate or phosphorodithioate linkage
  misc_feature (20)..(21): n is any nucleotide
  misc_feature (21)..(21): optionally attached glyceryl moiety
  misc_feature (1)..(19): ribonucleotide modified as described
aacucucuagcacuccaacnn

SEQ ID NO: 2760 - RNA, 14 nt, Artificial Sequence
  Synthetic
auauaucuauuucg

SEQ ID NO: 2761 - RNA, 14 nt, Artificial Sequence
  Synthetic
cgaaauaguauaua

SEQ ID NO: 2762 - RNA, 22 nt, Artificial Sequence
  Synthetic
cgaaauaguauauacuauuucg

SEQ ID NO: 2763 - DNA, 24 bp, Artificial Sequence
  Synthetic
  misc_feature (1)..(22): ribonucleotide modified as described
cgaaauaguauauacuauuucgtt

SEQ ID NO: 2764 - RNA, 15225 nt, Homo sapiens
acgcgaaaaaaugcguacuacaaacuugcacauucggaaaaaauggggcaaauaagaauuugauaagugcuauuuaagucuaaccuuuucaaucagaaauggggugcaauucacugagcaugauaaagguuagauuacaaaauuuauuugacaaugacgaaguagcauuguuaaaaauaacauguuauacugacaaauuaauucuucugaccaaugcauuagccaaagcagcaauacauacaauuaaauuaaacgguauaguuuuuauacauguuauaacaagcagugaagugugcccugauaacaacauuguaguaaaaucuaacuuuacaacaaugccaauauuacaaaacggaggauacauaugggaauugauugaguugacacacugcucucaauuaaacggucuaauggaugauaauugugaaaucaaauuuucuaaaagacuaagugacucaguaaugacuaauuauaugaaucaaauaucugauuuacuugggcuugaucucaauucaugaauuauguuuagucuaacucaauagacauguguuuauuaccauuuuaguuaauauaaaaacucaucaaagggaaauggggcaaauaaacucaccuaaucaaucaaacuaugagcacuacaaaugacaacacuacuaugcaaagauuaaugaucacggacaugagaccccugucgauggauucaauaauaacaucucucaccaaagaaaucaucacacacaaauucauauacuugauaaacaaugaauguauuguaagaaaacuugaugaaagacaagcuacauuuacauucuuagucaauuaugagaugaagcuacugcacaaaguagggaguaccaaauacaagaaauacacugaauauaauacaaaauauggcacuuuccccaugccuauauuuaucaaucauggcggguuucuagaauguauuggcauuaagccuacaaaacacacuccuauaauauacaaauaugaccucaacccguaaauuccaacaaaaaaaaccaacccaaccaaaccaagcuauuccucaaacaacaaugcucaauaguuaagaaggagcuaauccguuuuaguaauuaaaaauaaaaguaaagccaauaacauaaauuggggcaaauacaaagauggcucuuagcaaagucaaguuaaaugauacauuaaauaaggaucagcugcugucauccagcaaauacacuauucaacguaguacaggagauaauauugacacucccaauuaugaugugcaaaaacaccuaaacaaacuaugugguaugcuauuaaucacugaagaugcaaaucauaaauucacaggauuaauagguauguuauaugcuauguccagguuaggaagggaagacacuauaaagauacuuaaagaugcuggauaucauguuaaagcuaauggaguagauauaacaacauaucgucaagauauaaauggaaaggaaaugaaauucgaaguauuaacauuaucaagcuugacaucagaaauacaagucaauauugagauagaaucuagaaaauccuacaaaaaaaugcuaaaagagaugggagaaguggcuccagaauauaggcaugauucuccagacugugggaugauaauacuguguauagcagcacuuguaauaaccaaauuagcagcaggagacagaucaggucuuacagcaguaauuaggagggcaaacaaugucuuaaaaaaugaaauaaaacgcuacaagggucucauaccaaaggauauagcuaacaguuuuuaugaaguguuugaaaaacacccucaucuuauagauguuuuugugcacuuuggcauugcacaaucaucaacaagaggggguaguagaguugaaggaaucuuugcaggauuguuuaugaaugccuaugguucagggcaaguaaugcuaagauggggaguuuuagccaaaucuguaaaaaauaucaugcuaggucaugcuaguguccaggcagaaauggagcaaguuguggaagucuaugaguaugcacagaaguugggaggagaagcuggauucuaccauauauugaacaauccaaaagcaucauugcugucauuaacucaauuuccuaacuucucaagugugguccuaggcaaugcagcaggucuaggcauaaugggagaguauagagguacgccaagaaaccaggaucuuuaugaugcagccaaagcauaugcagagcaacucaaagaaaauggaguaauaaacuacaguguauuagacuuaacagcagaagaauuggaagccauaaagaaucaacucaacccuaaagaagaugauguagagcuuuaaguuaacaaaaaauacggggcaaauaagucaacauggagaaguuugcaccugaauuucauggagaagaugcaaauaacaaagcuaccaaauuccuagaaucaauaaagggcaaguucgcaucauccaaagauccuaagaagaaagauagcauaauaucuguuaacucaauagauauagaaguaaccaaagagagcccgauaacaucuggcaccaacaucaucaauccaacaagugaagccgacaguaccccagaaaccaaagccaacuacccaagaaaaccccuaguaagcuucaaagaagaucucaccccaagugacaacccuuuuucuaaguuguacaaagaaacaauagaaacauuugauaacaaugaagaagaaucuagcuacucauaugaagagauaaaugaucaaacaaaugacaacauuacagcaagacuagauagaauugaugaaaaauuaagugaaauauuaggaaugcuccauacauuaguaguugcaagugcaggacccacuucagcucgcgauggaauaagagaugcuaugguuggucugagagaagaaaugauagaaaaaauaagagcggaagcauuaaugaccaaugauagguuagaggcuauggcaagacuuaggaaugaggaaagcgaaaaaauggcaaaagacaccucagaugaagugccucuuaauccaacuuccaaaaaauugagugacuuguuggaagacaacgauagugacaaugaucugucacuugaugauuuuugaucagugaucaacucacucagcaaucaacaacaucaauaaaacagacaucaauccauugaaucaacugccagaccgaacaaacaaauguccgucagcggaaccaccaaccaaucaaucaaccaacugauccaucagcaaccugacgaaauuaacaauauaguaacaaaaaaagaacaagauggggcaaauauggaaacauacgugaacaagcuucacgaaggcuccacauacacagcagcuguucaguacaauguucuagaaaaagaugaugauccugcaucacuaacaauaugggugccuauguuccagucaucuguaccagcagacuugcucauaaaagaacuugcaagcaucaacauacuagugaagcagaucucuacgcccaaaggaccuucacuacgagucacgauuaacucaagaagugcugugcuggcucaaaugccuaguaauuucaucauaagcgcaaauguaucauuagaugaaagaagcaaauuagcauaugauguaacuacaccuugugaaaucaaagcaugcagucuaacaugcuuaaaagugaaaaguauguuaacuacagucaaagaucuuaccaugaagacauucaaccccacucaugagaucauugcucuaugugaauuugaaaauauuaugacaucaaaaagaguaauaauaccaaccuaucuaagaccaauuagugucaaaaacaaggaucugaacucacuagaaaacauagcaaccaccgaauucaaaaaugcuaucaccaaugcgaaaauuauucccuaugcuggauuaguauuaguuaucacaguuacugacaauaaaggagcauucaaauauaucaagccacagagucaauuuauaguagaucuuggugccuaccuagaaaaagagagcauauauuaugugacuacuaauuggaagcauacagcuacacguuuuucaaucaaaccacuagaggauuaaauuuaauuaucaacacugaaugacagguccacauauauccucaaacuacacacuauauccaaacaucaugaacaucuacacuacacacuucaucacacaaaccaaucccacucaaaauccaaaaucacuaccagccacuaucugcuagaccuagagugcgaauagguaaauaaaaccaaaauaugggguaaauagacauuaguuagaguucaaucaaucucaacaaccauuuauaccgccaauucaauacauauacuauaaaucuuaaaaugggaaauacauccaucacaauagaauucacaagcaaauuuuggcccuauuuuacacuaauacauaugaucuuaacucuaaucucuuuacuaauuauaaucacuauuaugauugcaauacuaaauaagcuaagugaacauaaaacauucuguaacaauacucuugaacuaggacagaugcaucaaaucaacacauagugcucuaccaucaugcugugucaaauuauaauccuguauauauaaacaaacaaauccaaucuucucacagagucauggugucgcaaaaccacgccaacuaucaugguagcauagaguaguuauuuaaaaauuaacauaaugaugaauuauuaguaugggaucaaaaacaacauuggggcaaaugcaaccauguccaaacacaagaaucaacgcacugccaggacucuagaaaagaccugggauacucucaaucaucuaauuguaauauccucuuguuuauacagauuaaauuuaaaaucuauagcacaaauagcacuaucaguucuggcaaugauaaucucaaccucucucauaauugcagccauaauauucaucaucucugccaaucacaaaguuacacuaacaacggucacaguucaaacaauaaaaaaccacacugaaaaaaacaucaccaccuaccuuacucaagucccaccagaaaggguuagcucauccaaacaaccuacaaccacaucaccaauccacacaaauucagccacaacaucacccaacacaaagucagaaacacaccacacaacagcacaaaccaaaggcagaaccaccaccucaacacagaccaacaagccgagcacaaaaccacgccuaaaaaauccaccaaaaaaaccaaaagaugauuaccauuuugaaguguucaacuucguucccuguaguauauguggcaacaaucaacuuugcaaauccaucuguaaaacaauaccaagcaacaaaccaaagaagaaaccaaccaucaaacccacaaacaaaccaaccaccaaaaccacaaacaaaagagacccaaaaacaccagccaaaacgacgaaaaaagaaacuaccaccaacccaacaaaaaaaccaacccucacgaccacagaaagagacaccagcaccucacaauccacugugcucgacacaaccacauuagaacacacaauccaacagcaaucccuccacucaaccacccccgaaaacacacccaacuccacacaaacacccacagcauccgagcccucuacaucaaauuccacccaaaauacccaaucacaugcuuaguuauucaaaaacuacaucuuagcagaaaaccgugaccuaucaagcaagaacgaaauuaaaccuggggcaaauaaccauggagcugcugauccacagguuaagugcaaucuuccuaacucuugcuauuaaugcauuguaccucaccucaagucagaacauaacugaggaguuuuaccaaucgacauguagugcaguuagcagagguuauuuuagugcuuuaagaacagguugguauaccagugucauaacaauagaauuaaguaauauaaaagaaaccaaaugcaauggaacugacacuaaaguaaaacuuauaaaacaagaauuagauaaguauaagaaugcagugacagaauuacagcuacuuaugcaaaacacaccagcugccaacaaccgggccagaagagaagcaccacaguauaugaacuauacaaucaauaccacuaaaaaccuaaauguaucaauaagcaagaagaggaaacgaagauuucugggcuucuuguuagguguaggaucugcaauagcaagugguauagcuguauccaaaguucuacaccuugaaggagaagugaacaagaucaaaaaugcuuuguuaucuacaaacaaagcuguagucagucuaucaaauggggucaguguuuuaaccagcaaaguguuagaucucaagaauuacauaaauaaccaauuauuacccauaguaaaucaacagagcugucgcaucuccaacauugaaacaguuauagaauuccagcagaagaacagcagauuguuggaaaucaacagagaauucagugucaaugcagguguaacaacaccuuuaagcacuuacauguuaacaaacagugaguuacuaucauugaucaaugauaugccuauaacaaaugaucagaaaaaauuaaugucaagcaauguucagauaguaaggcaacaaaguuauucuaucaugucuauaauaaaggaagaaguccuugcauauguuguacagcuaccuaucuaugguguaauagauacaccuugcuggaaauuacacacaucaccucuaugcaccaccaacaucaaagaaggaucaaauauuuguuuaacaaggacugauagaggaugguauugugauaaugcaggaucaguauccuucuuuccacaggcugacacuuguaaaguacaguccaaucgaguauuuugugacacuaugaacaguuugacauuaccaagugaagucagccuuuguaacacugacauauucaauuccaaguaugacugcaaaauuaugacaucaaaaacagacauaagcagcucaguaauuacuucucuuggagcuauagugucaugcuaugguaaaacuaaaugcacugcauccaacaaaaaucgugggauuauaaagacauuuucuaaugguugugacuaugugucaaacaaaggaguagauacugugucagugggcaacacuuuauacuauguaaacaagcuggaaggcaagaaccuuuauguaaaaggggaaccuauaauaaauuacuaugacccucuaguguuuccuucugaugaguuugaugcaucaauaucucaagucaaugaaaaaaucaaucaaaguuuagcuuuuauucguagaucugaugaauuacuacauaauguaaauacuggcaaaucuacuacaaauauuaugauaacuacaauuauuauaguaaucauuguaguauuguuaucauuaauagcuauugguuugcuguuguauugcaaagccaaaaacacaccaguuacacuaagcaaagaccaacuaaguggaaucaauaauauugcauucagcaaauagacaaaaaaccaccugaucauguuucaacaacagucugcugaucaccaaucccaaaucaacccauaacaaacacuucaacaucacaguacaggcugaaucauuucuucacaucaugcuacccacacaacuaagcuagauccuuaacucauaguuacauaaaaaccucaaguaucacaaucaaacacuaaaucaacacaucauucacaaaauuaacagcuggggcaaauaugucgcgaagaaauccuuguaaauuugagauuagaggucauugcuugaaugguagaagaugucacuacagucauaauuacuuugaauggccuccucaugccuuacuagugaggcaaaacuucauguuaaacaagauacucaagucaauggacaaaagcauagacacuuugucugaaauaaguggagcugcugaacuggacagaacagaagaauaugcucuugguauaguuggagugcuagagaguuacauaggaucuauaaacaacauaacaaaacaaucagcauguguugcuaugaguaaacuucuuauugagaucaauagugaugacauuaaaaagcugagagauaaugaagaacccaauucaccuaagauaagaguguacaauacuguuauaucauacauugagagcaauagaaaaaacaacaagcaaacaauccaucugcucaaaagacuaccagcagacgugcugaagaagacaauaaaaaacacauuagauauccacaaaagcauaaucauaagcaacccaaaagagucaaccgugaaugaucaaaaugaccaaaccaaaaauaaugauauuaccggauaaauauccuuguaguauaucauccauauugauuucaagugaaagcaugauugcuacauucaaucauaaaaacauauuacaauuuaaccauaaccauuuggauaaccaccagcguuuauuaaauaauauauuugaugaaauucauuggacaccuaaaaacuuauuagaugccacucaacaauuucuccaacaucuuaacaucccugaagauauauauacaauauauauauuagugucauaaugcuuggccauaacgauucuauaucauccaaccauaaaacuaucuuaauaagguuaugggacaaaauggaucccauuauuaauggaaacucugcuaauguguaucuaacugauaguuauuuaaaagguguuaucucuuuuucagaauguaaugcuuuagggaguuaccuuuuuaacggcccuuaucucaaaaaugauuacaccaacuuaauuaguagacaaaguccacuacuagagcauaugaaucuuaaaaaacuaacuauaacacagucauuaauaucuagauaucauaaaggugaacugaaauuagaagaaccaacuuauuuccagucauuacuuaugacauauaaaagcauguccucgucugaacaaauugcuacaacuaacuuacuuaaaaaaauaauacgaagagcuauagaaauaagugauguaaagguguacgccaucuugaauaaacuaggacuaaaggaaaaggacagaguuaagcccaacaauaauucaggugaugaaaacucaguacuuacaacuauaauuaaagaugauauacuuucggcuguggaaagcaaucaaucauauacaaauucagacaaaaaucacucaguaaaucaaaauaucacuaucaaaacaacacucuugaaaaaauugauguguucaaugcaacauccuccaucaugguuaauacacugguucaauuuauauacaaaauuaaauaacauauuaacacaauaucgaucaaaugagguaaaaagucauggguuuauauuaauagauaaucaaacuuuaagugguuuucaguuuauuuuaaaucaauaugguuguaucguuuaucauaaaggacucaaaaaaaucacaacuacuacuuacaaucaauuuuuaacauggaaagacaucagccuuagcagauuaaauguuugcuuaauuacuuggauaaguaauuguuugaauacauuaaauaaaagcuuagggcugagauguggauucaauaauguuguguuaucacaauuauuucuuuauggagauuguauacugaaauuauuucauaaugaaggcuucuacauaauaaaagaaguagagggauuuauuaugucuuuaauucuaaacauaacagaagaagaucaauuuaggaaacgauuuuauaauagcaugcuaaauaacaucacagaugcagcuauuaaggcucaaaagaaccuacuaucaaggguaugucacacuuuauuagacaagacagugucugauaauaucauaaaugguaaauggauaauccuauuaaguaaauuucuuaaauugauuaagcuugcaggugauaauaaucucaauaauuugagugagcuauauuuucucuucagaaucuuuggacauccaaugguugaugaaagacaagcaauggaugcuguaagaauuaacuguaaugaaacuaaguucuacuuauuaaguagucuaaguacguuaagaggugcuuucauuuauagaaucauaaaaggguuuguaaauaccuacaacagauggcccacuuuaaggaaugcuauuguccuaccucuaagaugguuaaacuauuauaaacuuaauacuuauccaucucuacuugaaaucacagaaaaugauuugauuauuuuaucaggauugcgguucuaucgugaauuucaucugccuaaaaaaguggaucuugaaaugauaauaaaugacaaagccauuucaccuccaaaagaucuaauauggacuaguuuuccuagaaauuacaugccaucacauauacaaaauuauauagaacaugaaaaguugaaguucucugaaagcgacagaucaagaagaguacuagaguauuacuugagagauaauaaauucaaugaaugcgaucuauacaauuguguagucaaucaaagcuaucucaacaacucuaaucacgugguaucacuaacugguaaagaaagagagcucaguguagguagaauguuugcuaugcaaccagguauguuuaggcaaauccaaaucuuagcagagaaaaugauagccgaaaauauuuuacaauucuucccugagaguuugacaagauauggugaucuagagcuucaaaagauauuagaauuaaaagcaggaauaagcaacaagucaaaucguuauaaugauaacuacaacaauuauaucaguaaauguucuaucauuacagaucuuagcaaauucaaucaagcauuuagauaugaaacaucauguaucugcagugauguauuagaugaacugcauggaguacaaucucuguucucuugguugcauuuaacaauaccucuugucacaauaauauguacauauagacaugcaccuccuuucauaaaggaucauguuguuaaucuuaaugaaguugaugaacaaaguggauuauacagauaucauaugggugguauugagggcuggugucaaaaacuguggaccauugaagcuauaucauuauuagaucuaauaucucucaaagggaaauucucuaucacagcucugauaaauggugauaaucagucaauugauauaaguaaaccaguuagacuuauagagggucagacccaugcucaagcagauuauuuguuagcauuaaauagccuuaaauugcuauauaaagaguaugcagguauaggccauaagcuuaagggaacagagaccuauauaucccgagauaugcaguucaugagcaaaacaauccagcacaauggaguguacuauccagccaguaucaaaaaaguccugagaguagguccauggauaaauacaauacuugaugauuuuaaaguuaguuuagaaucuauagguagcuuaacacaggaguuagaauacagaggggaaagcuuauuaugcaguuuaauauuuaggaacauuugguuauacaaucaaauugcuuugcaacuccgaaaucaugcauuauguaacaauaagcuauauuuagauauauugaaaguauuaaaacacuuaaaaacuuuuuuuaaucuugauaguaucgauauggcguuaucauuguauaugaauuugccuaugcuguuuggugguggugauccuaauuuguuauaucgaagcuuuuauaggagaacuccagacuuccuuacagaagcuauaguacauucaguguuuguguugagcuauuauacuggucacgauuuacaagauaagcuccaggaucuuccagaugauagacugaacaaauucuugacaugugucaucacauucgauaaaaaucccaaugccgaguuuguaacauugaugagggauccacaggcguuagggucugaaaggcaagcuaaaauuacuagugagauuaauagauuagcaguaacagaagucuuaaguauagcuccaaacaaaauauuuucuaaaagugcacaacauuauacuaccacugagauugaucuaaaugacauuaugcaaaauauagaaccaacuuacccucauggauuaagaguuguuuaugaaagucuaccuuuuuauaaagcagaaaaaauaguuaaucuuauaucaggaacaaaauccauaacuaauauacuugaaaaaacaucagcaauagauacaacugauauuaauagggcuacugauaugaugaggaaaaauauaacuuuacuuauaaggauacuuccacuagauuguaacaaagacaaaagagaguuauuaaguuuagaaaaucuuaguauaacugaauuaagcaaguauguaagagaaagaucuuggucauuauccaauauaguaggaguaacaucgccaaguauuauguucacaauggacauuaaauauacaacuagcacuauagccagugguauaauuauagaaaaauauaauguuaauaguuuaacucguggugaaagaggaccuacuaagccauggguagguucaucuacgcaggagaaaaaaacaaugccaguguacaauagacaaguuuuaaccaaaaagcaaagagaccaaauagauuuauuagcaaaauuagacuggguauaugcauccauagacaacaaagaugaauucauggaagaacugaguacuggaacacuuggacugucauaugaaaaagccaaaaaguuguuuccacaauaucuaagugucaauuauuuacaccguuuaacagucaguaguagaccaugugaauucccugcaucaauaccagcuuauagaacaacaaauuaucauuucgauacuaguccuaucaaucauguauuaacagaaaaguauggagaugaagauaucgacauuguguuucaaaauugcauaaguuuuggucuuagccugaugucgguuguggaacaauucacaaacauauguccuaauagaauuauucucauaccgaagcugaaugagauacauuugaugaaaccuccuauauuuacaggagauguugauaucaucaaguugaagcaagugauacaaaaacagcauauguuccuaccagauaaaauaaguuuaacccaauauguagaauuauuccuaaguaacaaagcacuuaaaucuggaucuaacaucaauucuaauuuaauauuaguacauaaaaugucugauuauuuucauaaugcuuauauuuuaaguacuaauuuagcuggacauuggauucuaauuauucaacuuaugaaagauucaaaagguauuuuugaaaaagauuggggagagggguacauaacugaucauauguucauuaauuugaauguuuucuuuaaugcuuauaagacuuauuugcuauguuuucauaaagguuaugguaaagcaaaauuagaaugugauaugaacacuucagaucuucuuuguguuuuggaguuaauagacaguagcuacuggaaaucuaugucuaaaguuuuccuagaacaaaaagucauaaaauacauagucaaucaagacacaaguuugcauagaauaaaaggcugucacaguuuuaaguugugguuuuuaaaacgccuuaauaaugcuaaauuuaccguaugcccuuggguuguuaacauagauuaucacccaacacauaugaaagcuauauuaucuuacauagauuuaguuagaaugggguuaauaaauguagauaaauuaaccauuaaaaauaaaaacaaauucaaugaugaauuuuacacaucaaaucucuuuuacauuaguuauaacuuuucagacaacacucauuugcuaacaaaacaaauaagaauugcuaauucagaauuagaagauaauuauaacaaacuauaucacccaaccccagaaacuuuagaaaauauaucauuaauuccuguuaaaaguaauaauaguaacaaaccuaaauuuuguauaaguggaaauaccgaaucuauaaugaugucaacauucucuaauaaaaugcauauuaaaucuuccacuguuaccacaagauucaauuauagcaaacaagacuuguacaauuuauuuccaaauguugugauagacaggauuauagaucauucagguaauacagcaaaaucuaaccaacuuuacaucaccacuucacaucagacaucuuuaguaaggaauagugcaucacuuuauugcaugcuuccuuggcaucaugucaauagauuuaacuuuguauuuaguuccacaggaugcaagaucaguauagaguauauuuuaaaagaucuuaagauuaaggaccccaguuguauagcauucauaggugaaggagcugguaacuuauuauuacguacgguaguagaacuucauccagacauaagauacauuuacagaaguuuaaaagauugcaaugaucauaguuuaccuauugaauuucuaagauuauacaacgggcauauaaacauagauuauggugagaauuuaaccauuccugcuacagaugcaacuaauaacauucauuggucuuauuuacauauaaaauuugcagaaccuauuagcaucuuugucugcgaugcugaauuaccuguuacagccaauuggaguaaaauuauaauugaauggaguaagcauguaagaaagugcaaguacuguucuucuguaaauagaugcauuuuaaucgcaaaauaucaugcucaagaugauauugauuucaaauuagauaacauuacuauauuaaaaacuuacgugugccuagguagcaaguuaaaaggaucugaaguuuacuuaguccuuacaauaggcccugcaaauauacuuccuguuuuugauguugugcaaaaugcuaaauugauuuuuucaagaacuaaaaauuucauuaugccuaaaaaaacugacaaggaaucuaucgaugcaaauauuaaaagcuuaauaccuuuccuuuguuacccuauaacaaaaaaaggaauuaagacuucauugucaaaauugaagaguguaguuaauggggauauauuaucauauucuauagcuggacguaaugaaguauucagcaacaagcuuauaaaccacaagcauaugaauauccuaaaauggcuagaucauguuuuaaauuuuagaucagcugaacuuaauuacaaucauuuauacaugauagaguccacauauccuuacuuaagugaauuguuaaauaguuuaacaaccaaugagcucaagaaacugauuaaaauaacagguaguguacuauacaaccuucccaacgaacaguaacuuaaaauaucauuaacaaguuuggucaaauuuagaugcuaacacaucauuauauuauaguuauuaaaaaauaugcaaacuuuucaauaauuuagcuuacugauuccaaaauuaucauuuuauuuuuaagggguugaauaaaagucuaaaacuaacaaugauacaugugcauuuacaacacaacgagacauuaguuuuugacacuuuuuuucucgu

What we claim is:

1. A chemically modified short interfering nucleic acid (siNA) molecule, wherein:
   (a) the siNA molecule comprises a sense strand and a separate antisense strand, each strand having one or more pyrimidine nucleotides and one or more purine nucleotides;
   (b) each strand is independently 18 to 27 nucleotides in length, and together comprise a duplex having between 17 and 23 base pairs;
   (c) the antisense strand is complementary to a human Respiratory Syncytial Virus (RSV) RNA sequence comprising SEQ ID NO:2764;
   (d) a plurality of the pyrimidine nucleotides present in the sense strand are 2'-deoxy-2'-fluoro pyrimidine nucleotides and a plurality of the purine nucleotides present in the sense strand are 2'-deoxy purine nucleotides; and,
   (e) a plurality of the pyrimidine nucleotides in the antisense strand are 2'-deoxy-2'-fluoro pyrimidine nucleotides and a plurality of the purine nucleotides present in the antisense strand are 2'-O-methyl purine nucleotides.

2. The siNA molecule of claim 1, wherein the sense strand includes a terminal cap moiety at both 5'- and 3'-ends.

3. The siNA molecule of claim 1, wherein the sense strand, the antisense strand, or both the sense strand and the antisense strand comprise a 3'-overhang.

4. The siNA molecule of claim 1, wherein the antisense strand has a phosphorothioate internucleotide linkage at the 3'-end.

5. A composition comprising the siNA molecule of claim 1 and a pharmaceutically acceptable carrier or diluent.

\* \* \* \* \*